United States Patent
Au-Young et al.

(10) Patent No.: US 6,500,938 B1
(45) Date of Patent: Dec. 31, 2002

(54) COMPOSITION FOR THE DETECTION OF SIGNALING PATHWAY GENE EXPRESSION

(75) Inventors: Janice Au-Young, Berkeley, CA (US); Jeffrey J. Seilhamer, Los Altos Hills, CA (US)

(73) Assignee: Incyte Genomics, Inc., Palo Alto, CA (US)

( * ) Notice: Subject to any disclaimer, the term of this patent is extended or adjusted under 35 U.S.C. 154(b) by 0 days.

(21) Appl. No.: 09/016,434

(22) Filed: Jan. 30, 1998

(51) Int. Cl.$^7$ .................. C07H 21/00; C07H 21/04; C12Q 1/68

(52) U.S. Cl. ................. 536/23.1; 422/50; 422/68.1; 435/6; 436/501; 536/24.1; 536/24.3; 536/24.31; 536/24.32; 536/24.33

(58) Field of Search ........................ 435/6, 69.1; 422/50, 422/68.1; 436/501; 536/23.1, 24.1, 24.3–24.33

(56) References Cited

FOREIGN PATENT DOCUMENTS

WO    WO 89/10977    * 11/1989

OTHER PUBLICATIONS

Sttwood, Science, vol. 290, No. 5491, pp. 471–473, 2000.*
Gerhold et al., BioEssays, vol. 18, No. 12, pp. 973–981, 1996.*
Wells et al., Journal of Leukocyte Biology, vol. 61, No. 5, pp. 545–550, 1997.*
Russell et al., Journal of Molecular Biology, vol. 244, pp. 332–350, 1994.*
Lashkari, D.A. et al., "Yeast microarrays for genome wide parallel genetic and gene expression analysis", *Proc. Natl. Acad. Sci. USA*, 94: 13057–13062 (1997).
Schena, M. et al., "Parallel human genome analysis: Microarray–based expression monitoring of 1000 genes", *Proc. Natl. Acad. Sci. USA*, 93: 10614–10619 (1996).
Heller, R.A. et al., "Discovery and analysis of inflammatory disease–related genes using cDNA microarrays", *Proc. Natl. Acad. Sci. USA*, 94: 2150–2155 (1997).
Schena, M. et al., "Quantitative Monitorin of Gene Expression Patterns with a Complementary DNA Microarray", *Science*, 270: 467–470 (1995).
Okubo, K. et al., "Large scale cDNA sequencing for analysis of quantitative and qualitative aspects of gene expression", *Nature Genetics*, 2: 173–179 (1992).
Lockhart, D.J. et al., "Expression monitoring by hybridization to high–density oligonucleotide arrays", *Nature Biotechnology*, 14: 1675–1680 (1996).
Atlas Human cDNA Expression Array I (1997) Clontech Laboratories, Inc. Online Catalog. 33 pages.
Wang, K. et al., "Monitoring gene expression profile changes in ovarian carcinomas using cDNA microarray", *Gene* 229: 101–108, (1999).
DeRisi, J. et al., "Use of a cDNA microarray to analyse gene expression patterns in human cancer", *Nat. Genet.* 14: 457–460 (1996).

* cited by examiner

*Primary Examiner*—Ardin H. Marschel
(74) *Attorney, Agent, or Firm*—Incyte Genomics, Inc.

(57) ABSTRACT

The present invention relates to a composition comprising a plurality of polynucleotide probes. The composition can be used as array elements in a microarray. The present invention also relates to a method for selecting polynucleotide probes of the composition.

5 Claims, No Drawings

COMPOSITION FOR THE DETECTION OF SIGNALING PATHWAY GENE EXPRESSION

FIELD OF THE INVENTION

The present invention relates to a composition comprising a plurality of polynucleotide probes for use in research and diagnostic applications.

BACKGROUND OF THE INVENTION

DNA-based arrays can provide a simple way to explore the expression of a single polymorphic gene or a large number of genes. When the expression of a single gene is explored, DNA-based arrays are employed to detect the expression of specific gene variants. For example, a p53 tumor suppressor gene array is used to determine whether individuals are carrying mutations that predispose them to cancer. The array has over 50,000 DNA probes to analyze more than 400 distinct mutations of p53. A cytochrome p450 gene array is useful to determine whether individuals have one of 18 known polymorphisms of two human cytochrome p450 genes. These polymorphisms can cause increased drug metabolism, drug resistance or drug toxicity.

DNA-based array technology is especially relevant to the rapid screening of expression of a large number of genes. There is a growing awareness that gene expression is affected in a global fashion. A genetic predisposition, disease or therapeutic treatment may affect, directly or indirectly, the expression of a large number of genes. In some cases the interactions may be expected, such as where the genes are part of the same signaling pathway. In other cases, such as when the genes participate in separate signaling pathways, the interactions may be totally unexpected. Therefore, DNA-based arrays can be used to investigate how genetic predisposition, disease, or therapeutic treatment affects the expression of a large number of genes.

It would be advantageous to prepare DNA-based arrays that can be used for monitoring the expression of a large number of genes coding for signaling pathway polypeptides, including different types of receptor, transducer and effector-like polypeptides. The present invention provides for a composition that can be employed in an array-format for detecting changes in expression of a large number of genes coding for different signaling pathway polypeptides.

SUMMARY OF THE INVENTION

In one aspect, the present invention provides a composition comprising a plurality of polynucleotide probes, wherein each of said polynucleotide probes comprises at least a portion of a gene coding for a signaling pathway polypeptide. The plurality of polynucleotide probes can comprise I) first polynucleotide probes, wherein each of said first polynucleotide probes comprises at least a portion of a gene coding for a receptor-like polypeptide; II) second polynucleotide probes, wherein each of said second polynucleotide probes comprises at least a portion of a gene coding for a transducing polypeptide; III) third polynucleotide probes, wherein each of said third polynucleotide probes comprises at least a portion of a gene coding for an effector-like polypeptide; or combinations thereof.

More particularly, in one preferred embodiment the composition comprises a plurality of polynucleotide probes wherein each gene coding for a signaling pathway polypeptide is at least a portion of a sequence selected from the group consisting of SEQ ID Nos: 1–1490. In a second preferred embodiment, the composition comprises a plurality of polynucleotide probes comprising at least a portion of at least 1000 of the sequences of SEQ ID Nos: 1–1490. In a third preferred embodiment, the composition comprises a plurality of polynucleotide probes wherein said polynucleotide probes comprise at least a portion of substantially all the sequences of SEQ ID Nos: 1–1490. The polynucleotide probes can be complementary DNAs, clone DNAs and the like.

The composition is particularly useful as hybridizable array elements in a microarray for monitoring the expression of a plurality of target polynucleotides. The microarray comprises a substrate and hybridizable array elements. The microarray of this invention is particularly useful in the diagnosis and treatment of cancer, an immunopathology, a neuropathology and the like.

In another aspect, the present invention encompasses an expression profile that can reflect the levels of a plurality of target polynucleotides in a sample. The expression profile comprises the microarray and a plurality of detectable complexes. Each detectable complex is formed by having at least one of the target polynucleotides hybridizing to at least one of the hybridizable array elements and further comprises a labeling moiety for detection. The expression profile of this invention is particularly useful in the diagnosis and the treatment of cancer, an immunopathology, a neuropathology and the like.

In yet another aspect, the invention provides a method for selecting a plurality of polynucleotide probes, said method comprising (I) obtaining a plurality of query sequences; (II) screening said query sequences against one or more databases comprising annotated sequences to identify sequence hits; and (III) selecting said sequence hits with the highest homology (top hits) to said annotated sequences. The query sequences can be expression sequence tags (ESTs) or full length gene coding sequences, which are electronically screened using preferably the Basic Local Alignment Search Tool (BLAST) algorithm. In one embodiment, the highest homology is identified as a BLAST score equal to or above 100 at a P-value equal to or below $10^{-10}$ against the GenPept database. In a second embodiment, the highest homology is identified as a percent sequence identity equal to or above 80% and a BLAST score equal to or above 250 against the GenBank Primate database. In a third embodiment, the highest homology is identified as a percent identity equal to or above 75% and a BLAST score equal to or above 250 against the GenBank Rodent database. In a fourth embodiment, the highest homology is identified as the match with the lowest P-value when searches are performed against GenPept, GenBank Primate or GenBank Rodent databases.

DESCRIPTION OF THE SEQUENCE LISTING AND TABLES

A portion of the disclosure of this patent document contains material which is subject to copyright protection. The copyright owner has no objection to the facsimile reproduction by anyone of the patent document or the patent disclosure, as it appears in the Patent and Trademark Office patent file or records, but otherwise reserves all copyright rights whatsoever.

The Sequence Listing is a compilation of nucleotide sequences obtained by sequencing clone inserts (isolates) of different cDNA libraries. Each sequence is identified by a sequence identification number (SEQ ID No:), by the clone number from which it was obtained and by the cDNA library from which the sequence was obtained.

Table 1 is a list of the sequences according to their SEQ ID Nos:. For SEQ ID Nos: 1–1049 (homologous to Gen-Bank sequences) the first column contains Incyte clone numbers. The second column contains a relevant GenBank identification number match, if any. The last column contains an annotation associated with the referenced GenBank identification number along with the genus species or source name. For SEQ ID Nos: 1050–1490 (exact matches to GenBank) the first column contains the GenBank identification number. The second column contains an annotation associated with the referenced GenBank identification number along with the genus species or source name.

Table 2 is a list of the cDNA libraries and a description of the preparation of the cDNA libraries.

DESCRIPTION OF THE INVENTION

Definitions

The term "microarray" refers to an ordered arrangement of hybridizable array elements. The array elements are arranged so that there are preferably at least about 10 different array elements, more preferably at least 100 array elements, and most preferably at least 1,000 array elements, on a 1 cm$^2$ substrate surface. The maximum number of array elements is unlimited, but is at least 100,000 array elements. Furthermore, the hybridization signal from each of the array elements is individually distinguishable. In a preferred embodiment, the array elements comprise polynucleotide probes.

A "polynucleotide" refers to a chain of nucleotides. Preferably, the chain has from 100 to 10,000 nucleotides, more preferably from 150 to 3,500 nucleotides. The term "probe" refers to the ability of the polynucleotide to hybridize with a target polynucleotide to form a polynucleotide probe/target complex. A "target polynucleotide" refers to a chain of nucleotides to which a polynucleotide probe can hybridize by base pairing. In some instances, the sequences will be complementary (no mismatches). In other instances, there may be a 5% mismatch.

A "plurality" refers preferably to a group of at least 10, more preferably to a group of at least 100, and even more preferably to a group of at least 1,000, members. The maximum number of members is unlimited, but is at least 100,000 members.

A "portion" means a stretch of at least 100 consecutive nucleotides. A "portion" can also mean a stretch of at least 100 consecutive nucleotides that contains one or more deletions, insertions or substitutions. A "portion" can also mean the whole coding sequence of a gene. Preferred portions are those that lack secondary structure as identified by using computer software programs such as OLIGO 4.06 Primer Analysis software (National Biosciences, Plymouth, Minn. LASERGENE (DNASTAR, Madison, Wis.) macDNAsis (Hitachi Software Engineering, South San Fransisco, Calif., and the like.

The term "gene" or "genes" (Hitachi Software Engineering, South San Francisco, Calif. refers to the partial or complete coding sequence of a gene. The phrase "genes coding for signaling pathway polypeptides" refers to genes that code for polypeptides that likely participate in signaling pathways and include those listed in Table 1.

The phrase "query sequences" refers to sequences whose identity or homology is being investigated. A "database" is a repository of information which is preferably accessible by electronic means. "Annotated sequences" are sequences whose identity has already been determined and preferably exist in a database. The phrase "percent sequence identity" refers to the percentage of identical match found in a comparison of two or more amino acid or nucleic acid sequences.

The Invention

The present invention provides a composition comprising a plurality of polynucleotide probes, wherein each polynucleotide probe comprises at least a portion of a gene coding for a signaling pathway polypeptide (SPP). Preferably, the sequences of the polynucleotide probes are selected from those sequences presented in the Sequence Listing. In one preferred embodiment the composition comprises a plurality of polynucleotide probes wherein each gene coding for a signaling pathway polypeptide is at least a portion of a sequence selected from the group consisting of SEQ ID Nos: 1–1490. In a second preferred embodiment, the composition comprises a plurality of polynucleotide probes comprising at least a portion of at least 1000 of the sequences of SEQ ID Nos: 1–1490. In a third preferred embodiment, the composition comprises a plurality of polynucleotide probes wherein said polynucleotide probes comprise at least a portion of substantially all the sequences of SEQ ID Nos: 1–1490.

The composition is particularly useful when it is used as hybridizable array elements in a microarray. The microarray can be used for large scale genetic or gene expression analysis of a large number of target polynucleotides. The microarrays can be used in the diagnosis of diseases and in the monitoring of treatments where altered expression of SPPs cause disease, such as in cancer, an immunopathology, a neuropathology, and the like. The microarrays can also be used to investigate an individual's predisposition to a disease, such as cancer, an immunopathology, a neuropathology, and the like.

When the composition of the invention is employed as hybridizable array elements in a microarray, the array elements are organized in an ordered fashion so that each element is present at a specified location on the substrate. Because the array elements are at specified locations on the substrate, the hybridization patterns and intensities (which together create a unique expression profile) can be interpreted in terms of expression levels of particular genes and can be correlated with a particular disease or condition or treatment.

The composition comprising a plurality of polynucleotide probes can also be used to purify a subpopulation of mRNAs, cDNAs, genomic fragments and the like, in a sample. Typically, samples will include the target polynucleotides of interest and other nucleic acids which may enhance the hybridization background in the sample. Therefore it may be advantageous to remove these nucleic acids. One method for removing the additional nucleic acids is by hybridizing the sample containing target polynucleotides with immobilized polynucleotide probes under hybridizing conditions. Those nucleic acids that do not hybridize to the polynucleotide probes are washed away. At a later point, the immobilized target polynucleotide probes can be released in the form of purified target polynucleotides.

Polynucleotide Probes

This section describes the selection of probe sequences for the plurality of polynucleotide probes. The probe sequences are derived from genes that code for signaling pathway polypeptides (SPPs) and can include gene sequences that fit in one of three different functional sequence groups (I through III). As a result, the composition of polynucleotide probes comprises sequences derived from genes of one of these functional sequence groups, the combination of any two of these functional sequence groups or from the combination of all three functional sequence groups. In a preferred embodiment, the composition comprises polynucleotide probes comprising sequences derived from all three functional sequence groups.

The functional sequence groups are divided as follows. Functional sequence group I comprises sequences for genes coding for receptor-like polypeptides. These polypeptides are able to sense the external environment of a cell and initiate a cascade of events. Included in this functional sequence group are binding proteins, receptor tyrosine kinases, G protein receptors, seven transmembrane domain receptors, tyrosine kinase receptors and the like. Functional sequence group II comprises sequences for genes coding for transducing polypeptides. These polypeptides transmit and amplify signals received from the receptor-like polypeptides. Included in this functional group are G proteins, growth and differentiation proteins, serine/threonine phosphatases, tyrosine phosphatases, phosphodiestereases, phospholipases, ras-related proteins, serine/threonine kinases, MAP kinases, adenylyl cyclases and the like. Functional sequence group III comprises sequences for genes coding for effector-like polypeptides. The effector-like polypeptides may perform a cellular function as a result of having sensed the signals from the transducing polypeptides. Included in this functional sequence group are cell matrix adhesion proteins, cell-cell adhesion proteins, ion channels, chemokines, cyclooxygenases, cytokines, hormones, nitric oxide synthases, proteases, protease inhibitors, transcription factors, transporter proteins and the like.

Genes for the functional sequence groups are selected by screening a large number of cDNA libraries, such as those described in Table 2, to discover clone inserts with sequences (listed in the Lifeseq databases) which are matches to genes coding for SPPs. The matches can be exact matches (100% identity) or homologous. As used herein, "homologous" refers to sequence similarity between a reference sequence and at least a portion of a newly sequenced clone insert, and can refer to either a nucleic acid or amino acid sequence. Preferably, regions of homology are identified using BLAST (Basic Local Alignment Search Tool). (See Altschul, S. F. (1993) *J. Mol. Evol* 36: 290–300; and Altschul et al. (1990) *J. Mol. Biol.* 215: 403–410). BLAST involves first finding similar segments between the query sequence and a database sequence, then evaluating the statistical significance of any matches that are found and finally reporting only those matches that satisfy a user-selectable threshold of significance. Alternatively, other search algorithms can be employed such as FASTA, a rapid sequencing algorithm described by Lippman and Pearson (1988; *PNAS* 85:2444–2448); ClustalW, a multiple sequence alignment program for DNA or proteins (Thompson et. al. (1994) *Nucl. Acid Res.* 22: 4673–4680); and the like.

In one preferred embodiment, full length gene coding sequences derived from the clone inserts are used as query sequences against sequences in public databases, such as the GenPept and GenBank databases (human, primate, and rodent databases). These databases contain previously identified and annotated sequences. In another embodiment, expression sequence tags (ESTs) are used as query sequences.

Top hit annotation is then performed. When an alignment between the query sequence and a sequence in any of the databases has a statistically significant score, the query sequence is annotated with the annotation of that sequence (resulting match). Sequences with the same annotation are placed in the same protein function tree, i.e., the tyrosine kinase tree, the serine/threonine kinase tree, the G protein tree and the like. A database employing protein functions to analyze sequence data is disclosed in copending patent application entitled "Database System Employing Protein Function Hierarchies for Viewing Biomolecular Sequence Data", Ser. No. 08/812,290, herein incorporated by reference. Several protein function trees are then combined to form functional sequence groups.

After identifying those sequences that have been annotated to the different protein function groups, polynucleotide probes are generated from these sequences. These sequences are provided in SEQ ID Nos: 1–1490 in the Sequence Listing. Table 1 provides the annotation for the referenced identification number for SEQ ID Nos: 1–1490.

The resulting composition can comprise polynucleotide probes that are not redundant, i.e., there is no more than one polynucleotide probe to represent a particular gene. Alternatively, the composition can comprise polynucleotide probes that are redundant, i.e., a gene is represented by more than one polynucleotide probe.

The selected polynucleotide probes may be manipulated further to optimize the performance of the polynucleotide probes as hybridization probes. Some probes may not hybridize effectively under hybridization conditions due to secondary structure. To optimize probe hybridization, the probe sequences are examined using a computer algorithm to identify portions of genes without potential secondary structure. Such computer algorithms are well known in the art, such as OLIGO 4.06 Primer Analysis software (National Biosciences), LASERGENE (DNASTAR) or MAcDNASIS (Hitachi). These programs can search nucleotide sequences to identify stem loop structures and tandem repeats and analyze the G+C content of the sequence (those sequences with a G+C content greater than 60% are excluded). Alternatively, the probes can be optimized by trial and error. Experiments can be performed to determine whether probes and target polynucleotides hybridize optimally under experimental conditions.

Where the number of different polynucleotide probes is desired to be greatest, the probe sequences are extended to assure that different polynucleotide probes are not derived from the same gene, i.e., the polynucleotide probes are not redundant. The probe sequences may be extended utilizing the partial nucleotide sequences derived from EST sequencing by employing various methods known in the art. For example, one method which may be employed, "restriction-site" PCR, uses universal primers to retrieve unknown sequence adjacent to a known locus (Sarkar, G. (1993) *PCR Methods Applic.* 2: 318–322).

Polynucleotide Probes

This section describes the polynucleotide probes. The polynucleotide probes can be DNA or RNA, or any RNA-like or DNA-like material. The polynucleotide probes can be sense or antisense polynucleotide probes. Where target polynucleotides are double stranded, the probes may be either sense or antisense strands. Where the target polynucleotides are single stranded, the nucleotide probes are complementary single strands.

In one embodiment, the polynucleotide probes are complementary DNAs (cDNAs). The size of the DNA sequence of interest may vary, and is preferably from 100 to 10,000 nucleotides, more preferably from 150 to 3,500 nucleotides.

In a second embodiment, the polynucleotide probes are clone DNAs. In this case the size of the DNA sequence of interest, i.e., the insert sequence excluding the vector DNA, may vary from 100 to 10,000 nucleotides, more preferably from 150 to 3,500 nucleotides.

The polynucleotide probes can be prepared by a variety of synthetic or enzymatic schemes which are well known in the art. The probes can be synthesized, in whole or in part, using chemical methods well known in the art. (Caruthers et al. (1980) Nucleic. Acids Res. Symp. Ser. (2). Alternatively, the probes can be generated, in whole or in part, enzymatically.

Nucleotide analogues can be incorporated into the polynucleotide probes by methods well known in the art. The only requirement is that most of the incorporated nucleotide analogues must serve to base pair with target polynucleotide sequences. For example, certain guanine nucleotides can be substituted with hypoxanthine which base pairs with cytosine residues. However, these base pairs are less stable than those between guanine and cytosine. Alternatively, adenine nucleotides can be substituted with 2, 6-diaminopurine which can form stronger base pairs than those between adenine and thymidine.

Additionally, the polynucleotide probes can include nucleotides that have been derivatized chemically or enzymatically. Typical chemical modifications include derivatization with acyl, alkyl, aryl or amino groups.

The polynucleotide probes can be immobilized on a substrate. Preferred substrates are any suitable rigid or semirigid support including membranes, filters, chips, slides, wafers, fibers, magnetic or nonmagnetic beads, gels, tubing, plates, polymers, microparticles and capillaries. The substrate can have a variety of surface forms, such as wells, trenches, pins, channels and pores, to which the polynucleotide probes are bound. Preferably, the substrates are optically transparent.

Probes can be synthesized, in whole or in part, on the surface of a substrate by using a chemical coupling procedure and an ink jet application apparatus, such as that described in PCT publication WO95/251116 (Baldeschweiler et al.). Alternatively, the probe can be synthesized using a self-addressable electronic device that controls when reagents are added (Heller et al. U.S. Pat. No. 5,605,662) or by photolysis using imaging fibers for light delivery (Healey et al. (1995) *Science* 269: 1078–80).

Complementary DNA (cDNA) can be arranged and then immobilized on a substrate. The probes can be immobilized by covalent means such as by chemical bonding procedures or UV. In one such method, a cDNA is bound to a glass surface which has been modified to contain epoxide or aldehyde groups. In another case, a cDNA probe is placed on a polylysine coated surface and then UV cross-linked (Shalon et al. PCT publication WO95/35505, herein incorporated by reference). In yet another method, a DNA is actively transported from a solution to a given position on a substrate by electrical means (Heller et al. U.S. Pat. No. 5,605,662). Alternatively, individual DNA clones can be gridded on a filter. Cells are lysed, proteins and cellular components degraded and the DNA coupled to the filter by UV cross-linking.

Furthermore, the probes do not have to be directly bound to the substrate, but rather can be bound to the substrate through a linker group. The linker groups are typically about 6 to 50 atoms long to provide exposure to the attached polynucleotide probe. Preferred linker groups include ethylene glycol oligomers, diamines, diacids and the like. Reactive groups on the substrate surface react with one of the terminal portions of the linker to bind the linker to the substrate. The other terminal portion of the linker is then functionalized for binding the polynucleotide probe.

The polynucleotide probes can be attached to a substrate by dispensing reagents for probe synthesis on the substrate surface or by dispensing preformed DNA fragments or clones on the substrate surface. Typical dispensers include a micropipette delivering solution to the substrate with a robotic system to control the position of the micropipette with respect to the substrate. There can be a multiplicity of dispensers so that reagents can be delivered to the reaction regions simultaneously.

Sample Preparation

In order to conduct sample analysis, a sample containing target polynucleotides is provided. The samples can be any sample containing target polynucleotides and obtained from any bodily fluid (blood, urine, saliva, phlegm, gastric juices, etc.), cultured cells, biopsies, or other tissue preparations.

The target polynucleotides can be DNA or RNA. The DNA or RNA can be isolated from the sample according to any of a number of methods well known to those of skill in the art. For example, methods of purification of nucleic acids are described in *Laboratory Techniques in Biochemistry and Molecular Biology: Hybridization With Nucleic Acid Probes. Part I. Theory and Nucleic Acid Preparation*, P. Tijssen, ed. Elsevier Science, New York, N.Y. (1993). In a preferred embodiment, total RNA is isolated using the TRIZOL total RNA isolation reagent (Life Technologies Gaithersburg, Md.) and mRNA is isolated using oligo d(T) column chromatography or glass beads.

Alternatively, the target polynucleotides may be derived from DNA or RNA. When target polynucleotides are derived from an mRNA, the target polynucleotides can be a cDNA reverse transcribed from an mRNA, an RNA transcribed from that cDNA, a DNA amplified from that cDNA, an RNA transcribed from the amplified DNA, and the like. When the target polynucleotide is derived from DNA, the target polynucleotide can be DNA amplified from DNA or RNA reverse transcribed from DNA. In yet another alternative, the targets are target polynucleotides prepared by more than one method.

When target polynucleotides are amplified it is desirable to amplify the nucleic acid sample and maintain the relative abundances of the original sample, including low abundance transcripts. Total mRNA can be amplified by reverse transcription using a reverse transcriptase and a primer consisting of oligo d(T) and a sequence encoding the phage T7 promoter to provide a single stranded DNA template. The second cDNA strand is polymerized using a DNA polymerase and a RNAse which assists in breaking up the DNA/RNA hybrid. After synthesis of the double stranded cDNA, T7 RNA polymerase can be added and RNA transcribed from the second cDNA strand template (Van Gelder et al. U.S. Pat. No. 5,545,522). RNA can be amplified in vitro, in situ or in vivo (See Eberwine U.S. Pat. No. 5,514,545).

It is also advantageous to include quantitation controls within the sample to assure that amplification and labeling procedures do not change the true distribution of target polynucleotides in a sample. For this purpose, a sample is spiked with a known amount of a control target polynucleotide and the composition of polynucleotide probes includes reference polynucleotide probes which specifically hybridize with the control target polynucleotides. After hybridization and processing, the hybridization signals obtained should reflect accurately the amounts of control target polynucleotide added to the sample.

Prior to hybridization, it may be desirable to fragment the nucleic acid target polynucleotides. Fragmentation improves hybridization by minimizing secondary structure and cross-hybridization to other nucleic acid target polynucleotides in the sample or noncomplementary polynucleotide probes. Fragmentation can be performed by mechanical or chemical means.

The target polynucleotides may be labeled with one or more labeling moieties to allow for detection of hybridized probe/target polynucleotide complexes. The labeling moieties can include compositions that can be detected by spectroscopic, photochemical, biochemical, bioelectronic, immunochemical, electrical, optical or chemical means. The labeling moieties include radioisotopes, such as $^{32}$P, $^{33}$P or $^{35}$S, chemiluminescent compounds, labeled binding proteins, heavy metal atoms, spectroscopic markers, such as fluorescent markers and dyes, magnetic labels, linked enzymes, mass spectrometry tags, spin labels, electron transfer donors and acceptors, and the like.

Exemplary dyes include quinoline dyes, triarylmethane dyes, phthaleins, azo dyes, cyanine dyes and the like. Preferably, fluorescent markers absorb light above about 300 nm, preferably above 400 nm, and usually emit light at wavelengths at least greater than 10 nm above the wavelength of the light absorbed. Specific preferred fluorescent markers include fluorescein, phycoerythrin, rhodamine, lissamine, and C3 and C5 available from Amersham.

Labeling can be carried out during an amplification reaction, such as polymerase chain and in vitro transcription reactions, or by nick translation or 5' or 3'-end-labeling reactions. In one case, labeled nucleotides are used in an in vitro transcription reaction. When the label is incorporated after or without an amplification step, the label is incorporated by using terminal transferase or by kinasing the 5' end of the target polynucleotide and then incubating overnight with a labeled oligonucleotide in the presence of T4 RNA ligase.

Alternatively, the labeling moiety can be incorporated after hybridization once a probe/target complex has formed. In one case, biotin is first incorporated during an amplification step as described above. After the hybridization reaction, unbound nucleic acids are rinsed away so that the only biotin remaining bound to the substrate is that attached to target polynucleotides that are hybridized to the polynucleotide probes. Then, an avidin-conjugated fluorophore, such as avidin-phycoerythrin, that binds with high affinity to biotin is added. In another case, the labeling moiety is incorporated by intercalation into preformed target/polynucleotide probe complexes. In this case, an intercalating dye such as a psoralen-linked dye can be employed.

Under some circumstances it may be advantageous to immobilize the target polynucleotides on a substrate and have the polynucleotide probes bind to the immobilized target polynucleotides. In such cases the target polynucleotides can be attached to a substrate as described above.

Hybridization and Detection

Hybridization causes a denatured polynucleotide probe and a denatured complementary target to form a stable duplex through base pairing. Hybridization methods are well known to those skilled in the art (See, for example, *Laboratory Techniques in Biochemistry and Molecular Biology*, Vol. 24: *Hybridization With Nucleic Acid Probes*, P. Tijssen, ed. Elsevier Science, New York, N.Y. (1993)). Conditions can be selected for hybridization where exactly complementary target and polynucleotide probe can hybridize, i.e., each base pair must interact with its complementary base pair. Alternatively, conditions can be selected where target and polynucleotide probes have mismatches but are still able to hybridize. Suitable conditions can be selected, for example, by varying the concentrations of salt or formamide in the prehybridization, hybridization and wash solutions, or by varying the hybridization and wash temperatures.

Hybridization can be performed at low stringency with buffers, such as 6×SSPE with 0.005% Triton X-100 at 37° C., which permits hybridization between target and polynucleotide probes that contain some mismatches to form target polynucleotide/probe complexes. Subsequent washes are performed at higher stringency with buffers, such as 0.5×SSPE with 0.005% Triton X-100 at 50° C., to retain hybridization of only those target/probe complexes that contain exactly complementary sequences. Alternatively, hybridization can be performed with buffers, such as 5×SSC/0.2% SDS at 60° C. and washes are performed in 2×SSC/0.2% SDS and then in 0.1×SSC. Stringency can also be increased by adding agents such as formamide. Background signals can be reduced by the use of detergent, such as sodium dodecyl sulfate, Sarcosyl or Triton X-100, or a blocking agent, such as sperm DNA.

Hybridization specificity can be evaluated by comparing the hybridization of specificity-control polynucleotide probes to specificity-control target polynucleotides that are added to a sample in a known amount. The specificity-control target polynucleotides may have one or more sequence mismatches compared with the corresponding polynucleotide probes. In this manner, whether only complementary target polynucleotides are hybridizing to the polynucleotide probes or whether mismatched hybrid duplexes are forming is determined.

Hybridization reactions can be performed in absolute or differential hybridization formats. In the absolute hybridization format, target polynucleotides from one sample are hybridized to the probes in a microarray format and signals detected after hybridization complex formation correlate to target polynucleotide levels in a sample. In the differential hybridization format, the differential expression of a set of genes in two biological samples is analyzed. For differential hybridization, target polynucleotides from both biological samples are prepared and labeled with different labeling moieties. A mixture of the two labeled target polynucleotides is added to a microarray. The microarray is then examined under conditions in which the emissions from the two different labels are individually detectable. Probes in the microarray that are hybridized to substantially equal numbers of target polynucleotides derived from both biological samples give a distinct combined fluorescence (Shalon et al. PCT publication WO95/35505). In a preferred embodiment, the labels are fluorescent labels with distinguishable emission spectra, such as a lissamine conjugated nucleotide analog and a fluorescein conjugated nucleotide analog. In another embodiment Cy3/Cy5 fluorophores (Amersham) Pharmacia Biotech, Piscataway, N.J. are employed.

After hybridization, the microarray is washed to remove nonhybridized nucleic acids and complex formation between the hybridizable array elements and the target polynucleotides is detected.

Methods for detecting complex formation are well known to those skilled in the art. In a preferred embodiment, the target polynucleotides are labeled with a fluorescent label and measurement of levels and patterns of fluorescence indicative of complex formation is accomplished by fluorescence microscopy, preferably confocal fluorescence microscopy. An argon ion laser excites the fluorescent label, emissions are directed to a photomultiplier and the amount of emitted light detected and quantitated. The detected signal should be proportional to the amount of probe/target polynucleotide complex at each position of the microarray. The fluorescence microscope can be associated with a computer-driven scanner device to generate a quantitative two-dimensional image of hybridization intensity. The scanned image is examined to determine the abundance/expression level of each hybridized target polynucleotide.

In a differential hybridization experiment, target polynucleotides from two or more different biological samples are labeled with two or more different fluorescent labels with different emission wavelengths. Fluorescent signals are detected separately with different photomultipliers set to detect specific wavelengths. The relative abundances/expression levels of the target polynucleotides in two or more samples is obtained.

Typically, microarray fluorescence intensities can be normalized to take into account variations in hybridization intensities when more than one microarray is used under similar test conditions. In a preferred embodiment, individual polynucleotide probe/target complex hybridization intensities are normalized using the intensities derived from internal normalization controls contained on each microarray.

Expression Profiles

This section describes an expression profile using the composition of this invention. The expression profile can be used to detect changes in the expression of genes coding for SPPs. These genes include genes whose altered expression is correlated with cancer, immunopathology, neuropathology and the like.

The expression profile comprises the polynucleotide probes of the invention. The expression profile also includes a plurality of detectable complexes. Each complex is formed by hybridization of one or more polynucleotide probes to one or more target polynucleotides. At least one of the polynucleotide probes, preferably a plurality of polynucleotide probes, is hybridized to a target polynucleotide forming, at least one, preferably a plurality of complexes. A complex is detected by incorporating at least one labeling moiety in the complex. The labeling moiety has been described above.

The expression profiles provide "snapshots" that can show unique expression patterns that are characteristic of a disease or condition.

Utility of the Invention

The composition comprising a plurality of polynucleotide probes can be used as hybridizable array elements in a microarray. Such a microarray can be employed in several applications including diagnostics and treatment regimens, drug discovery and development, toxicological and carcinogenicity studies, forensics, pharmacogenomics and the like.

In one situation, the microarray is used to monitor the progression of disease. Researchers can assess and catalog the differences in gene expression between healthy and diseased tissues or cells. By analyzing changes in patterns of gene expression, disease can be diagnosed at earlier stages before the patient is symptomatic.

Similarly, the invention can be used to monitor the progression of disease or the efficacy of treatment. For some treatments with known side effects, the microarray is employed to fine-tune the treatment regimen. A dosage will be established that causes a change in genetic expression patterns indicative of successful treatment. Expression patterns associated with undesirable side effects are avoided. This approach may be more sensitive and rapid than waiting for the patient to show inadequate improvement, or manifest symptoms, before altering the course of treatment.

Alternatively, animal models which mimic a disease rather than patients can be used to characterize expression profiles associated with a particular disease or condition. For example, a characteristic gene expression pattern for the graft versus host reaction can be generated using analogous reactions that occur when lymphocytes from one donor are mixed with lymphocytes from another donor. This gene expression data may be useful in diagnosing and monitoring the course of graft versus host reaction in a patient, in determining gene targets for intervention, and in testing novel immunosuppressants.

The microarray is particularly useful for diagnosing and monitoring the progression of diseases that may be associated with the altered expression of SPPs. The expression of SPPs is closely associated with cell proliferation. Thus, the microarray and expression profiles are particularly useful to diagnose a cancer such as adenocarcinoma, leukemia, lymphoma, melanoma, myeloma, sarcoma and teratocarcinoma. Such cancers include, but are not limited to, cancers of the adrenal gland, bladder, bone, bone marrow, brain, breast, cervix, gall bladder, ganglia, gastrointestinal tract, heart, kidney, liver, lung, muscle, ovary, pancreas, parathyroid, penis, prostate, salivary glands, skin, spleen, testis, thymus, thyroid and uterus.

The expression of SPPs is also closely associated with an immune response. Therefore, the microarray can be used to diagnose immunopathologies including but not limited to AIDS, Addison's disease, adult respiratory distress syndrome, allergies, anemia, asthma, atherosclerosis, bronchitis, cholecystitus, Crohn's disease, ulcerative colitis, atopic dermatitis, dermatomyositis, diabetes mellitus, emphysema, atrophic gastritis, glomerulonephritis, gout, Graves' disease, hypereosinophilia, irritable bowel syndrome, lupus erythematosus, multiple sclerosis, myasthenia gravis, myocardial or pericardial inflammation, osteoarthritis, osteoporosis, pancreatitis, polymyositis, rheumatoid arthritis, scleroderma, Sjögren's syndrome, and autoimmune thyroiditis; viral, bacterial, fungal, parasitic, and protozoal infections and trauma.

Neuronal processes are also affected by the expression of SPPs. Thus, the microarray can be used to diagnose neuropathologies including but not limited to akathesia, Alzheimer's disease, amnesia, amyotrophic lateral sclerosis, bipolar disorder, catatonia, cerebral neoplasms, dementia, depression, Down's syndrome, tardive dyskinesia, dystonias, epilepsy, Huntington's disease, multiple sclerosis, neurofibromatosis, Parkinson's disease, paranoid psychoses, schizophrenia, and Tourette's disorder.

The invention also allows researchers to develop sophisticated profiles of the effects of currently available therapeutic drugs. Tissues or cells treated with these drugs can be analyzed using the invention, and compared to untreated samples of the same tissues or cells. In this way, an expression profile of known therapeutic agents will be developed. Knowing the identity of sequences that are differentially regulated in the presence and absence of a drug will allow researchers to elucidate the molecular mechanisms of action of that drug.

Also, researchers can use the invention to rapidly screen large numbers of candidate drugs, looking for ones that have an expression profile similar to those of known therapeutic drugs, with the expectation that molecules with the same expression profile will likely have similar therapeutic effects. Thus, the invention provides the means to determine the molecular mode of action of a drug.

It is understood that this invention is not limited to the particular methodology, protocols, and reagents described, as these may vary. It is also understood that the terminology used herein is for the purpose of describing particular embodiments only, and is not intended to limit the scope of the present invention which will be limited only by the appended claims. The examples below are provided to illustrate the subject invention and are not included for the purpose of limiting the invention.

EXAMPLES

I cDNA Library Construction

For purposes of example, the preparation and sequencing of the LNODNOT03 cDNA library, from which Incyte Clone 1577179 was isolated, is described in detail. The insert of clone 1577179 codes for a transcriptional repressor protein. Preparation and sequencing of cDNAs in libraries in the LifeSeq® database have varied over time, and the gradual changes involved use of kits, plasmids, and machinery available at the particular time the library was made and analyzed.

The LNODNOT03 cDNA library was constructed from microscopically normal lymph node tissue excised from a 67-year-old Caucasian male. This tissue was associated with tumorous lung tissue. The patient history included squamous cell carcinoma of the lower lobe, benign hypertension, arteriosclerotic vascular disease, and tobacco abuse. The patient was taking Doxycycline, a tetracycline, to treat an infection.

The frozen tissue was homogenized and lysed using a POLYTRON homogenizer (PT-3000; (Brinkmann Instruments, Westbury, N.J.) in guanidinium isothiocyanate solution. The lysate was centrifuged over a 5.7 M CsCl cushion using an SW28 rotor in a L8-70M Ultracentrifuge (Beckman Coulter, Palo Alto, Calif., for 18 hours at 25,000 rpm at ambient temperature. The RNA was extracted with acid phenol pH 4.7, precipitated using 0.3 M sodium acetate and 2.5 volumes of ethanol, resuspended in RNAse-free water, and DNase treated at 37° C. The RNA extraction was repeated with acid phenol pH 4.7 and precipitated with sodium acetate and ethanol as before. The mRNA was then isolated using the OLIGOTEX Kit (Qiagen), Inc., Chatsworth, Calif.) and used to construct the cDNA library.

The mRNA was handled according to the recommended protocols in the SUPERSCRIPT plasmid system (Life Technologies). cDNAs were fractionated on a SEPHAROSE CL4B column (Amersham Pharmacia Biotech), and those cDNAs exceeding 400 BP were ligated into pSPORT1. plasmid. The plasmid was subsequently transformed into DH5® competent cells (Life Technologies).

II cDNA Library Normalization

In some cases, cDNA libraries have been normalized in a single round according to the procedure of Soares et al. (1994 *Proc. Natl. Acad. Sci.* 91: 9928–9932), herein incorporated by reference, with the following modifications. The primer to template ratio in the primer extension reaction was increased from 2:1 to 10:1. The ddNTP concentration in this reaction was reduced to 150 $\mu$M each, allowing the generation of longer (400–100 nt) primer extension products. The reannealing hybridization was extended from 13 to 48 hours. The single stranded DNA circles of the normalized library were purified by hydroxyapatite chromatography and converted to partially double-stranded by random priming, followed by electroporation into DH10B competent bacteria (Life Technologies).

The Soares normalization procedure is designed to reduce the initial variation in individual cDNA frequencies to achieve abundances within one order of magnitude while maintaining the overall sequence complexity of the library. In the normalization process, the prevalence of high-abundance cDNA clones decreases significantly, clones with mid-level abundance are relatively unaffected, and clones for rare transcripts are effectively increased in abundance. In the modified Soares normalization procedure, significantly longer hybridization times are used which allows for the increase of gene discovery rates by biasing the normalized libraries toward low-abundance cDNAs that are well represented in a standard transcript image.

III Isolation and Sequencing of cDNA Clones

Plasmid cDNA was released from the cells and purified using the REAL Prep 96 plasmid kit (Qiagen). The recommended protocol was employed except for the following changes: 1) the bacteria were cultured in 1 ml of sterile Terrific Broth (Life Technologies) with carbenicillin at 25 mg/L and glycerol at 0.4%; 2) after inoculation, the cultures were incubated for 19 hours and at the end of incubation, the cells were lysed with 0.3 ml of lysis buffer; and 3) following isopropanol precipitation, the plasmid DNA pellet was resuspended in 0.1 ml of distilled water. After the last step in the protocol, samples were transferred to a 96-well block for storage at 40° C.

cDNAs were prepared and sequenced according to the method of Sanger et al. ((1975), *J. Mol. Biol.* 94: 441f), using the CATALYST 800 (PE Biosystems, Foster City, Cailf.) or a MICROLAB 2200 (Hamilton, Reno, Nev.) in combination with DNA ENGINE thermal cyclers (PTC200 from MJ Research, Watertown, Mass.) and ABI 377 or 373 DNA Sequencing systems (PE Biosystems), and the reading frame was determined.

IV Selection of Polynucleotide Probes

Polynucleotide probe sequences were identified from GenBank (Release97) and from LIFESEQ v.4.3 and LIFESEQ FL v.1.0 databases (Incyte Pharmaceuticals, Palo Alto, Calif.). Clone inserts (sequences contained in the LIFESEQ databases) were searched for regions of homology (similarity) to GenBank sequences using BLAST, which stands for Basic Local Alignment Search Tool (Altschul (1990) *J. Mol. Biol.* 215: 403–10)

BLAST produces alignments of a query nucleotide or query amino acid sequence to a subject nucleotide or subject amino acid sequence. BLAST is useful for determining exact matches or identifying homologs of ESTs or full length gene coding sequences. Each alignment contains statistical values of any matches found, and the user can determine the threshold of significance (based on p-value, % identity and Blast scores).

The basis of the search is the product score, which is defined as:

$$\% \text{ sequence identity} \times \% \text{ maximum BLAST score}/100$$

The product score takes into account both the degree of similarity between two sequences and the length of the sequence match as reflected in the BLAST score. The BLAST score is calculated by scoring +5 for every base that matches in an HSP (High scoring Segment Pair) and −4 for every mismatch. For example, with a product score of 40, the match will be exact within a 1% to 2% error, and, with a product score of 70, the match will be exact. Homologous molecules are usually identified by selecting those which show product scores between 15 and 40, although lower scores may identify related molecules. The P-value for any given HSP is a function of its expected frequency of occurrence and the number of HSPs observed against the same database sequence with scores at least as high.

Percent sequence identity refers to the percentage of sequence match found in a comparison of two or more amino acid or nucleic acid sequences. Percent identity can be determined electronically, e.g., by using the MEGALIGN program (DNASTAR). The percentage similarity between two amino acid sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no homology between the two amino acid sequences are not included in determining percentage similarity.

For the purposes of this invention, top hit annotation to any of the functional sequence groups described above was used for selection of sequences for use as polynucleotide probes. When an alignment had a statistically significant score, the query sequence was annotated with the annotation of the subject (resulting match). The sequences were first analyzed against the GenPept database. Matches received a P-value indicating the probability that a match between a LIFESEQ FL (Incyte) sequence and a GenPept sequence is due to random chance. Matches also received a BLAST score that indicates the quality of the alignment between two sequences. The hit P-value threshold was set at $10^{-10}$, and the BLAST score was equal to or above 100 for annotation against the GenPept database. If the comparison produced a match equal to or above this threshold (that is, a match with a P-value below $10^{-10}$), the sequence was annotated with the appropriate match information and further comparisons to GenPept were halted. If there was more than one match, the most significant match (lowest P-value) was used.

If a LIFESEQ FL sequence did not match any GenPept entry above the P-value threshold, it was then compared against the GenBank Primate (gbpri) database. Annotation was based on the Percent Identity and BLAST score of a match. The sequence inherited annotation from the GI (GenBank identifier) that produced the most significant match equal to or above a Percent Identitiy of 80 and a minimum BLAST score of 250. If no match was found at these thresholds, then the comparison was repeated with the GenBank Rodent (gbrod) database at a Percent Identity threshold equal to or above 75 and a minimum BLAST score of 250.

If no match was found at these thresholds, then the most significant match from the GenPept database, i.e., the match with the lowest P-value was selected. If there was no such match, then the most significant match from GenBank Primate was chosen. If again there was no match, the most significant match from GenBank Rodent was chosen.

Once the sequences were annotated, they were assigned to a protein function tree using keywords and definitions parsed from the corresponding GenBank (genpept) report. A database employing protein functions to analyze sequence data is disclosed in copending patent application entitled "Database System Employing Protein Function Hierarchies for Viewing Biomolecular Sequence Data", Ser. No. 08/812, 290, herein incorporated by reference. The GenBank identifier for each sequence was associated with a Protein Function ID (PFID). The sequences were assigned to different PFIDs. Once the sequence has a PFID, it was combined in a functional sequence group as described.

V Preparation of Microarrays

A. Gridding of Clone DNAs

A single 22×22 cm nylon filter is spotted with 18,394 non-redundant human cDNA clones. The clones are robotically picked and arrayed into 384 well culture dishes. The cultures are gridded, using a Q-BOT robot (Genetix, christchurch DVK), onto nylon membranes in a double spotting pattern at a density of 36,864 spots per filter or 18,394 individual genes and 38 double spotted controls. The filters are suitable for standard hybridization protocols.

The filters are placed onto LB agar media with carbenicillin in bioassay trays and grown for about 16 hrs at 42° C. The filters are then saturated for 4 minutes with denaturing buffer (1.5M NaCl, 0.5M NaOH) by placing the filters (with the filter colony face up) on top of a piece of Whatman paper that has previously been saturated with the denaturing buffer.

The denaturing buffer is maintained at 95 to 100° C. by use of a water bath. Excess denaturing buffer is removed. New filters are then saturated for 4 minutes with neutralizing buffer by placing the filters (with the filter colony face up) on top of a piece of Whatman paper that has previously been saturated with the neutralizing buffer. The filters are dried until no liquid is visible on the filter.

A filter is then submerged for 1 hour, colony side down, in 100 ml prewarmed (42° C.) proteinase K buffer (0.1 M NaCl, 50 mM EDTA pH 8.5, 50 mM Tris pH 8.0, 1% Sarcosyl, Proteinase K(1 mg/ml)). The filter is then retrieved and placed on a piece of dry Whatman paper to dry overnight. The filter is then exposed to UV to cross-link the DNA to the filter (254 nm for 40 seconds using a GS Gene Linker UV Chamber (Bard)).

mRNA (5 micrograms) and 2 microliters random hexamer (0.5 mg/ml) (Life Technologies) are combined in a 1.5 ml RNase free microcentrifuge tube. The sample is incubated at 70° C. for 10 minutes, placed on ice for five minutes, lyophilized to dryness and then dissolved in the following: 1.6 microliters 5×1st Strand Buffer, 0.8 microliters 0.1 M DTT, 0.4 microliters 10 mM dA/dG/dT mix, 4.0 microliters [$^{32}$P] dCTP (3000 Ci/mmol, 10 uCi/microliter) and 1.2 microliters SuperScript II RT (200 U/microliter)(Life Technologies).

The sample is centrifuged and incubated at 42° C. for 1–2 hours. The sample is then diluted with 42 microliters of sterile water. Unincorporated nucleotides are removed with a G-50 spin column PROBEQUANT G-50 microcolumns containing SEPHADEX G-50 DNA Grade F; Amersham Pharmacia Biotech).

The purified sample is boiled at 95° C. for 3 minutes and then put on ice. To degrade mRNA, 12.5 microliters of 1N NaOH are added to the sample and, incubated at 37° C. for 10 minutes. The sample is neutralized by addition of 12.5 microliters Tris pH 6.8 and 10.0 microliters 1 M HCl . Degraded RNA is removed with a G-50 purification column (same as above).

For hybridization, the procedure described by Soares is followed (Soares et al. *PNAS* (1994) 91: 9228–9232). Ten mls prewarmed (42° C.) hybridization buffer (0.75 M NaCl, 0.1 M NaPO$_4$, 0.1% (w/v) NaP$_2$O$_7$, 0.15 M Tris (pH 7.5), 5×Denhardt Solution, 2% SDS, sheared salmon testes DNA (100 micrograms/ml), 50% form amide) are added to the filters in hybridization bags for >2 hours to overnight for prehybridization. Radiolabelled probe ($^{32}$P) is added to a new 10 ml aliquot of the pre-warmed hybridization buffer and hybridization is allowed to proceed at 42° C. for 14–16 hours.

After hybridization, filters are rinsed with 200 ml 2×SSC at room temperature for 5 minutes, then washed with prewarmed 2×SSC, 1% SDS, and washed two more times with pre-warmed wash 2 (0.6×SSC, 1% SDS) for 30 minutes at 68° C. Damp filters are imaged on a phosphoimager, with a two-night screen exposure.

B. Jettina of cDNAs on Glass Slides

Glass slides (3 inches length, 1 inch width) are placed in a rack (Wheaton, 39 glass slides maximum). The glass slide rack is dipped in 350 ml of 1 M sodium hydroxide solution for 3 hours, rinsed with distilled water 4 times, dipped in distilled water for 1 hour, dipped in 0.1 N hydrochloric acid solution for 1 hour, rinsed with distilled water 0 4 times, dipped in distilled water for 1 hour, rinsed with acetone, and dried in an oven (120° C.) for overnight (12 to 24 hours). The glass slides are cooled and stored at room temperature.

The glass slides are then placed in three glass slide racks (25 slides in each rack). Glass slide racks are placed in a 2000 ml Ace reaction flask with a stirring bar. 1230 ml of toluene, 170 ml of 3-glycidoxypropyl-trimethoxysilane and 5 ml of N, N-diisopropylethylamine are added. The resulting mixture is stirred and heated at 85° C. for 60 to 72 hours. After cooling the reaction mixture the slide racks are taken out and washed with toluene, ethanol, hexane, and acetone. The glass slides in the rack are dried under nitrogen for 10 minutes and stored in a desiccator for use.

The activated glass surface is reacted with cDNAs of 200 to 4,000 nucleotides in length. The cDNAs are generated using two rounds of PCR. The first round of PCR is initiated from bacterial cells with plasmids (pBLUESCRPT, pINCY, pSPORT) containing the DNAs of interest using a PCR kit (Amersham Pharmacia Biotech). The second round of PCR is carried out with the primers pINpSPL and pINpSPU for pINCY and pSPORT plasmids or with the KS1A and KS2A primers for the pBLUESCRPT plasmids. cDNAs products are then purified using column chromatography (QIAQUICK 96, Qiagen), eluted in water and dried down. The cDNAs are resuspended in water and adjusted to 0.1×SCC, 0.1% SDS for a final concentration of 0.02–1 micromolar. Samples are then filtered through a 2 micron disposable filter (B-100, Upchurch Scientific, Oak Harbor, Wash.) and loaded into a 384 well plate which is covered with foil to prevent evaporation and left overnight. Alternatively, custom manufactured oligonucleotides (Operon, Technologies, Alameda, Calif., Life Technologies (20 to 70 nucleotide in length) are dissolved to 7.5 micromolar in 0.1×SCC, 0.1% SDS and used instead of the PCR fragments.

After addition of the cDNAs, the following steps are performed using GeneJetII, an automated, computer-controlled robotic arraying instrument (Incyte). After attaching the probes, the remaining reactive sites on the substrate are capped by soaking the substrate for 1 minute in 0.2% SDS, 1 minute in deionized water, 1 minute in fresh deionized water, 5 minutes in boiling deionized water, 1 minute in 0.2% SDS, and 2 more 1 minute washes with deionized water.

Total RNA is isolated from cells or tissues using the TRIZOL total RNA isolation reagent (Life Technologies). Poly(A) mRNA is isolated from total RNA with an oligo d(T) selection step using the OLIGOTEX procedure and kit (Qiagen). Double-stranded cDNA is synthesized using an oligo d(T) primer modified to incorporate a T7 RNA polymerase promoter site and a cDNA synthesis kit (Life Technologies). The final composition for the first strand reaction is 50 mM Tris-HCl pH 8.3, 75 mM KCl, 3 mM MgCl$_2$, 10 mM DTT, 50 micromolar each dATP, dCTP, dGTP, and dTTP, 0.2 micromolar T7-(T)24 primer, 0.1 M DTT, 100 microgram/ml poly (A) RNA and 10,000 units/ml cloned M-MLV reverse transcriptase (Life Technologies). The reaction mixture is incubated for one hour at 37° C.

For second strand synthesis, the following reaction mixture is added to the first strand reaction mixture: 25 mM Tris-HCl pH 8.3, 100 mM KCl, 10 mM ammonium sulfate, 5 mM MgCl$_2$, 5 mM DTT, 250 micromolar each dATP, dCTP, dGTP, and dTTP, 0.15 mM AND, 250 U/ml DNA polymerase I, 8.5 U/ml Rnase H and 30 U/ml DNA ligase. The reaction mixture is incubated for two hours at 16° C. To quench the reaction, the reaction was placed on ice and EDTA was added. The reaction mixture is extracted with phenol and precipitated with ethanol.

For in vitro transcription, labeled UTP and CTP (1:3 labeled to unlabeled) plus unlabeled ATP and GTP is used in the reaction with T7 MEGASCRIPT in vitro transcription kit (Ambion, Austin, Tex.). The reaction mixture (30 microliters) is prepared as follows: 7.5 mM ATP, 7.5 mM GTP, 5 mM cold UTP/1.67 mM biotin-UTP (Enzo) Biochem, New York, N.Y. 5 mM cold CTP/1.67 mM biotin-CTP (Enzo) Biochem, 1.5 microgram cDNA, 3 microliters 10×T7 transcription buffer (Ambion) and 2 microliters T7 enzyme mix (Ambion). The reaction proceeds for about 6 hours at 37° C. RNA is precipitated with lithium chloride. Then, the nucleic acid is fragmented at 94° C. for 30 minutes in the presence of magnesium and potassium ions prior to hybridization (40 mM Tris-acetate, pH 8.1, 100 mM KOAc and 30 mM MgOAc). Unincorporated labeled nucleotides are removed using a G25 spin column (Amersham Pharmacia Biotech).

After amplification and labeling of the sample, the sample is dissolved in 6×SSPE, 0.005% Triton X-100, 0.5 mg/ml HS DNA, 50% formamide, 5 to 10 microliters are placed on the array spots, a coverslip is placed on top and the assembly placed in a humidified chamber. The assembly is incubated at 20 to 80° C. for 2 to 72 hours. Lower temperatures are generally used for olignucleotide array elements than for PCR fragments.

The following protocol is performed to wash and stain probe/target complexes: 5 minutes in 1×SSC/0.2%SDS at 30° C., followed by 5 minutes in 0.1×SSC/0.2 SDS at room temperature, followed by 5 minutes in 0.1×SSC/0.2%SDS/ 1%BSA/2 micrograms/ml streptavidin-phycoerythrin (Molecular Probes) at 40° C., and for 30 minutes in 0.1× SCC at room temperature. The arrays are read using a scanning confocal microscope. The scanner uses an argon ion laser as the excitation source, and the emission is detected with a photomultiplier tube through a 560 nm longpass filter.

TABLE 1

| | CLONE ID | MATCH GI | ANNOTATION |
|---|---|---|---|
| SEQ ID NO: 1 | 000504 | 915 | rab10 gene [*Canis familiaris*] |
| SEQ ID NO: 2 | 001705 | 1256362 | zinc finger protein. [house mouse] |
| SEQ ID NO: 3 | 003803 | 265483 | HZF-16 = Kruppel-related zinc finger gene homolog {alternatively [human HEP-G2 hepatoblastoma cell line] |
| SEQ ID NO: 4 | 008915 | 293678 | immune suppressor. [house mouse] |
| SEQ ID NO: 5 | 010773 | 157535 | goliath protein. [fruit fly] |
| SEQ ID NO: 6 | 011615 | 1681 | protein phosphatase 1. [European rabbit] |
| SEQ ID NO: 7 | 013353 | 402648 | *H. sapiens* rel proto-oncogene mRNA. [human] |
| SEQ ID NO: 8 | 014309 | 312468 | *H. sapiens* Brn3B mRNA. [human] |
| SEQ ID NO: 9 | 014360 | 722236 | GNRHR gonadotropin-releasing hormone receptor [human] |
| SEQ ID NO: 10 | 016624 | INCYTE | zinc finger protein [*Homo sapiens*] |

TABLE 1-continued

| SEQ ID NO: 11 | 020293 | 463254 | interleukin 8. [sheep.] |
| --- | --- | --- | --- |
| SEQ ID NO: 12 | 022878 | 1017721 | Human repressor transcriptional factor (ZNF85) mRNA, complete cds. [human.] |
| SEQ ID NO: 13 | 024266 | 200523 | protein tyrosine phosphatase. [house mouse.] |
| SEQ ID NO: 14 | 026841 | 265483 | HZF-16 = Kruppel-related zinc finger gene homolog {alternatively [human HEP-G2 hepatoblastoma cell line.] |
| SEQ ID NO: 15 | 026879 | 805295 | lymphocyte specific helicase [mouse] |
| SEQ ID NO: 16 | 027044 | 303596 | Human mRNA for GC-Box binding protein BTEB2, complete cds. [*Homo sapiens* placenta cDNA to mRNA, clone_lib:lambda gt11.] |
| SEQ ID NO: 17 | 027099 | 1199604 | zinc finger protein C2H2-25. [human.] |
| SEQ ID NO: 18 | 027211 | 338478 | zinc finger protein. [human.] |
| SEQ ID NO: 19 | 027244 | 841318 | zinc finger protein [*Homo sapiens*] |
| SEQ ID NO: 20 | 029167 | 1377880 | ligatin. [house mouse.] |
| SEQ ID NO: 21 | 029592 | 1791003 | macrophage inflammatory protein 3 beta. [human.] |
| SEQ ID NO: 22 | 030443 | 56041 | precursor cystatin c c-terminal fragment [Norway rat] |
| SEQ ID NO: 23 | 032020 | 498722 | *H. sapiens* HZF2 mRNA for zinc finger protein. [human.] |
| SEQ ID NO: 24 | 033273 | 265483 | HZF-16 = Kruppel-related zinc finger gene homolog {alternatively [human HEP-G2 hepatoblastoma cell line.] |
| SEQ ID NO: 25 | 033760 | 930083 | Kruppel-related protein [*Mus musculus*] |
| SEQ ID NO: 26 | 033849 | 1742909 | Human mRNA for RNA helicase (HRH1), complete cds. [*Homo sapiens* cell-line HeLa cDNA to mRNA.] |
| SEQ ID NO: 27 | 035379 | 1903458 | myosin heavy chain kinase B. [*Dictyostelium discoideum.*] |
| SEQ ID NO: 28 | 039043 | 200999 | *Mus musculus* (clone 2) serum inducible kinase (SNK) mRNA, mRNA [*Mus musculus* cDNA to mRNA.] |
| SEQ ID NO: 29 | 039200 | 1657697 | Human hyaluronan receptor (RHAMM) mRNA, complete cds. [human.] |
| SEQ ID NO: 30 | 040194 | 1827451 | *Homo sapiens* mRNA for VRK2, complete cds. [*Homo sapiens* fetal liver cDNA to mRNA.] |
| SEQ ID NO: 31 | 040601 | 1695739 | M130 of smooth muscle myosin phosphatase. [pig.] |
| SEQ ID NO: 32 | 041879 | 1681 | protein phosphatase 1. [European rabbit.] |
| SEQ ID NO: 33 | 046081 | 1245048 | serine/threonine kinase. [*Caenorhabditis elegans.*] |
| SEQ ID NO: 34 | 053078 | 200407 | pMLZ-4. [house mouse.] |
| SEQ ID NO: 35 | 054065 | 1256421 | Human protein kinase PAK1 mRNA, complete cds. [human.] |
| SEQ ID NO: 36 | 054312 | 336719 | Chinese Hamster mitochondrial ATPase 6 and URF A6L genes, complete [Mitochondrion DNA from Chinese hamster ovary cells.] |
| SEQ ID NO: 36 | 054312 | 336719 | mitochondrial ATPase 6 and URF A6L genes [*Cricetulus griseus*] |
| SEQ ID NO: 37 | 054329 | 57783 | Rat mRNA for calpastatin. [*Rattus sp.*] |
| SEQ ID NO: 38 | 056494 | 2094873 | DAP-kinase. [human.] |
| SEQ ID NO: 39 | 063010 | 498720 | *H. sapiens* HZF10 mRNA for zinc finger protein. [human.] |
| SEQ ID NO: 40 | 065020 | 1418775 | *H. sapiens* mRNA for epsilon isoform of 61kDa regulatory subunit of [human.] |
| SEQ ID NO: 41 | 068399 | 190423 | Human protein phosphatase 2A beta subunit mRNA, complete cds. [Human fetal brain, cDNA to mRNA.] |
| SEQ ID NO: 42 | 077546 | 1772560 | *H. sapiens* mRNA for transcription factor TBX5. [human.] |
| SEQ ID NO: 43 | 077736 | 182849 | G0S19-2 peptide precursor. [human.] |
| SEQ ID NO: 44 | 084476 | 1785654 | neuroserpin. [human.] |
| SEQ ID NO: 45 | 085523 | 1708767 | contains a domain found in band 4.1, ezrin, moesin, radixin and [*Caenorhabditis elegans* strain = Bristol N2.] |
| SEQ ID NO: 47 | 087825 | 339727 | secreted protein G-26. [human.] |
| SEQ ID NO: 48 | 088200 | 1399862 | *Rattus norvegicus* GDNF receptor alpha mRNA, complete cds. [Norway rat.] |
| SEQ ID NO: 49 | 088564 | 1790925 | macrophage inflammatory protein 3 alpha. [human.] |
| SEQ ID NO: 50 | 090012 | 183421 | GNRHR gonadotropin-releasing hormone receptor [*Homo sapiens*] |
| SEQ ID NO: 51 | 090447 | 790531 | glutamate/kainate receptor subunit [*Homo sapiens*] |
| SEQ ID NO: 52 | 090818 | 1041090 | *Rattus norvegicus* sodium channel II mRNA. [*Rattus norvegicus* cDNA to mRNA.] |
| SEQ ID NO: 53 | 090851 | 443688 | Rat eukaryotic hemin-sensitive initiation factor 2a kinase (eIF-2a) [*Rattus norvegicus* (strain Sprague-Dawley) cDNA to mRNA.] |
| SEQ ID NO: 54 | 091945 | 1923265 | Human AP-3 complex delta subunit mRNA, complete cds. [human.] |
| SEQ ID NO: 55 | 092298 | 35789 | Human HPTP delta mRNA for protein tyrosine phosphatase delta. [human.] |
| SEQ ID NO: 56 | 093414 | 291873 | putative. [human.] |
| SEQ ID NO: 57 | 093797 | 732796 | PRR1 gene product [*Homo sapiens*] |
| SEQ ID NO: 58 | 093801 | 162627 | ADP-ribosylation factor. [cow.] |
| SEQ ID NO: 59 | 095210 | 456269 | zinc finger protein 30. [western European house mouse.] |
| SEQ ID NO: 60 | 097307 | 1681 | protein phosphatase 1. [European rabbit.] |
| SEQ ID NO: 61 | 1001651 | 161664 | zinc finger protein. [red flour beetle.] |
| SEQ ID NO: 62 | 100279 | 1620664 | phogrin. [human.] |
| SEQ ID NO: 63 | 1003663 | INCYTE | RING zinc finger protein [*Gallus gallus*] |
| SEQ ID NO: 64 | 1004370 | 1314359 | smooth muscle LIM protein. [human.] |
| SEQ ID NO: 65 | 101415 | 1871197 | Human 16 chromosome BAC clone CIT987SK-962B4 complete sequence. [human.] |
| SEQ ID NO: 66 | 104119 | 1321818 | RING zinc finger protein. [chicken.] |
| SEQ ID NO: 67 | 104941 | 1336041 | HsOLF1. [human.] |
| SEQ ID NO: 68 | 105400 | 455015 | DNA-binding protein. [house mouse.] |
| SEQ ID NO: 69 | 108614 | 296696 | *M. musculus* sox-4 mRNA. [house mouse.] |
| SEQ ID NO: 70 | 111294 | 340443 | Human zinc finger protein 41 (ZNF41) gene, 3' end. [*Homo sapiens* (tissue library: Laoxnloi: 577 ATCC) adult DNA.] |

TABLE 1-continued

| SEQ ID NO: | | | |
|---|---|---|---|
| SEQ ID NO: 71 | 111639 | 505548 | zinc-finger protein (ZNFpT7). [human.] |
| SEQ ID NO: 72 | 112132 | 498720 | *H. sapiens* HZF10 mRNA for zinc finger protein. [human.] |
| SEQ ID NO: 73 | 112530 | 163076 | G protein gamma-5 subunit. [cow.] |
| SEQ ID NO: 74 | 112808 | 163084 | guanine nucleotide-binding regulatory protein gamma-3 subunit. [cow.] |
| SEQ ID NO: 75 | 112909 | 1685324 | zinc finger protein 1. [Norway rat.] |
| SEQ ID NO: 76 | 113700 | 1321599 | Cdc42. [house mouse.] |
| SEQ ID NO: 77 | 114290 | 1769490 | Human kruppel-related zinc finger protein (ZNF184) mRNA, partial [human.] |
| SEQ ID NO: 78 | 114973 | 1669684 | *H. sapiens* mRNA for protein kinase, Dyrk4, partial. [human.] |
| SEQ ID NO: 79 | 119819 | 1914855 | WW domain binding protein 6; WBP6/SRPK-1. [house mouse.] |
| SEQ ID NO: 80 | 120376 | 561543 | serine/threonine protein kinase. [human.] |
| SEQ ID NO: 81 | 1210401 | 746415 | I kappa BR [*Homo sapiens*] |
| SEQ ID NO: 82 | 1210506 | 1589738 | CHUK. [human.] |
| SEQ ID NO: 83 | 1215274 | 1819666 | 566c1, complete sequence. [human.] |
| SEQ ID NO: 84 | 121894 | 1777754 | Human protein tyrosine phosphatase PTPCAAX1 (hPTPCAAX1) mRNA, [human.] |
| SEQ ID NO: 85 | 1221143 | 1125764 | coded for by *C. elegans* cDNA yk21f1.5; coded for by *C. elegans* cDNA [*Caenorhabditis elegans.*] |
| SEQ ID NO: 86 | 1223546 | 633037 | 130 kDa myosin-binding subunit of smooth muscle myosin phosphatase [*Gallus gallus*] |
| SEQ ID NO: 87 | 1223714 | 57911 | *M. musculus* HCNGP mRNA. [house mouse.] |
| SEQ ID NO: 88 | 1229372 | 1039076 | *H. sapiens* CpG island DNA genomic MseI fragment, 85 clone, forward [human.] |
| SEQ ID NO: 89 | 1231274 | 1890117 | *Homo sapiens* casein kinase I gamma 2 mRNA, complete cds. [human.] |
| SEQ ID NO: 90 | 1231667 | 1107687 | homologue of Drosophila Fat protein. [human.] |
| SEQ ID NO: 91 | 1234795 | 1109782 | protein-tyrosine phosphatase. [human.] |
| SEQ ID NO: 92 | 1238083 | 289686 | homology with 4-nitrophenylphosphatase and mouse synaptosomal [*Caenorhabditis elegans.*] |
| SEQ ID NO: 93 | 1238311 | 1022714 | sodium channel alpha-subunit. [European rabbit.] |
| SEQ ID NO: 94 | 1242602 | 2149087 | multidrug resistance protein-1. [sheep.] |
| SEQ ID NO: 95 | 1243031 | 1706967 | calcium-binding protein chp. [human.] |
| SEQ ID NO: 96 | 1243069 | 2073569 | cDNA encoding nuclear chloride ion channel. [human.] |
| SEQ ID NO: 97 | 1243412 | 1667393 | Human transcriptional regulator homolog RPD3 mRNA, complete cds. [human.] |
| SEQ ID NO: 98 | 1251148 | 1107687 | homologue of Drosophila Fat protein. [human.] |
| SEQ ID NO: 99 | 1251228 | 292495 | Human global transcription activator homologous sequence mRNA, [*Homo sapiens* fibroblast cDNA to mRNA.] |
| SEQ ID NO: 100 | 1252862 | 1542955 | transcription factor XTCF-3d. [African clawed frog.] |
| SEQ ID NO: 101 | 1255202 | 1277085 | *Cavia porcellus* CGRP-receptor component protein mRNA, complete cds. [domestic guinea pig.] |
| SEQ ID NO: 102 | 1255239 | 308766 | Human zinc finger protein 20 (ZNF20) pentanucleotide repeat [*Homo sapiens* DNA.] |
| SEQ ID NO: 103 | 1256053 | 1620540 | Human Frizzled related protein Frzb precursor (fzrb) mRNA, complete [human.] |
| SEQ ID NO: 104 | 1257462 | 975335 | interleukin-11 receptor alpha chain [*Homo sapiens*] |
| SEQ ID NO: 105 | 1258320 | 1946343 | secreted frizzled related protein sFRP-2. [house mouse.] |
| SEQ ID NO: 106 | 1261646 | 600885 | *Mus musculus* signal recognition particle receptor beta subunit [mouse.] |
| SEQ ID NO: 107 | 1266440 | 190421 | Human protein phosphatase 2A alpha subunit mRNA, complete cds. [Human lung fibroblast cell line WI38, cDNA to mRNA.] |
| SEQ ID NO: 108 | 1268848 | 532559 | putative serine/threonine protein kinase. [fruit fly.] |
| SEQ ID NO: 109 | 1269556 | 452444 | glucose-6-phosphatase. [human.] |
| SEQ ID NO: 110 | 1270334 | 1905905 | *Homo sapiens* DNA from 19 chromosome.2 cosmids R31240, R30272 and [human.] |
| SEQ ID NO: 111 | 1270442 | 190222 | protein phosphatase 2A 72 kDa regulatory subunit. [human.] |
| SEQ ID NO: 112 | 1272054 | 297157 | rab17. [house mouse.] |
| SEQ ID NO: 113 | 1274145 | 263309 | Vgr-2 = transforming growth factor-beta homolog [mice, embryo, mRNA, [*Mus sp.* embryo.] |
| SEQ ID NO: 114 | 1281655 | 206809 | Rat pot. G protein coupled receptor (RTA) mRNA, complete cds. [Rat (strain Sprague Dawley) adult thoracic aorta, cDNA to mRNA,] |
| SEQ ID NO: 115 | 1282128 | 1166574 | *Rattus norvegicus synaptojanin* mRNA, complete cds. [Norway rat strain = Sprague-Dawley.] |
| SEQ ID NO: 116 | 1283291 | 1914774 | *H. sapiens* mRNA for inositol 1,4,5-trisphosphate 3-kinase. [human.] |
| SEQ ID NO: 117 | 1287810 | 531156 | *Mus musculus* AKR voltage-gated potassium-channel (KCNA4) gene, [house mouse.] |
| SEQ ID NO: 118 | 1290913 | 189510 | p70 ribosomal S6 kinase alpha-II. [human.] |
| SEQ ID NO: 119 | 1291082 | 998898 | scleraxis = basic helix-loop-helix transcription factor [mouse] |
| SEQ ID NO: 120 | 1292876 | 265430 | 14-3-3 protein gamma subtype, 14-3-3 gamma = putative protein kinase [rats brain.] |
| SEQ ID NO: 121 | 1296847 | 1321818 | RING zinc finger protein. [chicken.] |
| SEQ ID NO: 122 | 1298633 | 1899225 | Human iroquois-class homeodomain protein IRX-5 mRNA, partial cds. [human.] |
| SEQ ID NO: 123 | 1301193 | 1679668 | mitogen-activated kinase kinase kinase 5. [human.] |
| SEQ ID NO: 124 | 1303605 | INCYTE | protein-tyrosine phophatase [*Homo sapiens*] |
| SEQ ID NO: 125 | 1305513 | INCYTE | opsin = RH2 group [*Astyanax fasciatus*] |

TABLE 1-continued

| SEQ ID NO: | | | |
|---|---|---|---|
| SEQ ID NO: 126 | 1309709 | 1929061 | map kinase interacting kinase. [house mouse.] |
| SEQ ID NO: 127 | 1311434 | 440389 | epsilon-COP. [cow.] |
| SEQ ID NO: 128 | 1312824 | 180551 | Human cis-acting sequence. [*Homo sapiens* Adult cDNA to mRNA.] |
| SEQ ID NO: 129 | 1313615 | 33991 | 1D-myo-inositol-trisphosphate 3-kinase. [human.] |
| SEQ ID NO: 130 | 1316844 | 1066165 | coat protein gamma-cop. [*aurochs*.] |
| SEQ ID NO: 131 | 1317663 | 1033992 | *H. sapiens* CpG island DNA genomic Mse1 fragment, 55 clone, [human.] |
| SEQ ID NO: 132 | 1318463 | 1770564 | preprotein translocase. [human.] |
| SEQ ID NO: 133 | 1318926 | 2072784 | Na+/nucleoside cotransporter. [human.] |
| SEQ ID NO: 134 | 1319543 | 1439562 | Cdc28p. [fission yeast.] |
| SEQ ID NO: 135 | 1320009 | 304671 | DEAD-box protein. [fruit fly.] |
| SEQ ID NO: 136 | 1321876 | 1262844 | *Mus musculus* ATP-dependent RNA helicase mRNA, partial cds. [house mouse.] |
| SEQ ID NO: 137 | 1322075 | 2088668 | similar to *Achlya ambisexualis* antheridiol steroid receptor [*Caenorhabditis elegans* strain = Bristol N2.] |
| SEQ ID NO: 138 | 1322305 | 1575660 | Human calcium-activated potassium channel hSK1 (SK) mRNA, complete [human.] |
| SEQ ID NO: 139 | 132240 | 1853976 | protein kinase. [fission yeast.] |
| SEQ ID NO: 140 | 132739 | 64704 | G10 protein, zinc finger protein [*Xenopus laevis*] |
| SEQ ID NO: 141 | 1329634 | 984114 | ribosome receptor [*Canis familiaris*] |
| SEQ ID NO: 142 | 1330522 | 308766 | Human zinc finger protein 20 (ZNF20) pentanucleotide repeat [*Homo sapiens* DNA.] |
| SEQ ID NO: 143 | 133140 | 1871200 | multidrug resistance-associated protein. [human.] |
| SEQ ID NO: 144 | 1336317 | 506412 | cadherin-8. [human.] |
| SEQ ID NO: 145 | 1337114 | 166306 | steroid receptor. [*Achlya ambisexualis*.] |
| SEQ ID NO: 146 | 1338358 | 456189 | *H. sapiens* F11 mRNA. [human.] |
| SEQ ID NO: 147 | 1340202 | 1236649 | *Rattus norvegicus* kidney protein phosphatase 1 myosin binding [Norway rat strain = Wistar.] |
| SEQ ID NO: 148 | 1340712 | 203152 | *Rattus norvegicus* branched-chain alpha-ketoacid dehydrogenasekinase [*Rattus norvegicus* (strain Sprague-Dawley) (library: lambda-gt11)] |
| SEQ ID NO: 149 | 1342719 | 186665 | potassium channel protein. [human.] |
| SEQ ID NO: 150 | 1346025 | INCYTE | olfactory protein [*Rattus norvegicus*] |
| SEQ ID NO: 151 | 1346050 | 1020144 | Human DNA binding protein (HPF2) mRNA, complete cds. [human.] |
| SEQ ID NO: 152 | 1354139 | 190222 | protein phosphatase 2A 72 kDa regulatory subunit. [human.] |
| SEQ ID NO: 153 | 1362803 | 289404 | chloride channel protein. [cow.] |
| SEQ ID NO: 154 | 1363431 | 452444 | glucose-6-phosphatase. [human.] |
| SEQ ID NO: 155 | 1363825 | 1199603 | Human zinc finger protein C2H2-25 mRNA, complete cds. [human.] |
| SEQ ID NO: 156 | 1365530 | 1669511 | Human death receptor 3 (DR3) mRNA, complete cds. [human.] |
| SEQ ID NO: 157 | 1366285 | 1222544 | *Mus musculus* putative cerebral cortex transcriptional regulator [house mouse strain = BALB/c.] |
| SEQ ID NO: 158 | 1367234 | 2108051 | Human cGMP-stimulated 3',5'-cyclic nucleotide phosphodiesterase [human.] |
| SEQ ID NO: 159 | 1379718 | 36034 | rhoC coding region (AA 1-193). [human.] |
| SEQ ID NO: 160 | 138100 | 499072 | Wee1 Hu. [human.] |
| SEQ ID NO: 161 | 1392516 | 1326113 | calcium influx channel. [human.] |
| SEQ ID NO: 162 | 1398545 | 790790 | protein kinase I [*Rattus norvegicus*] |
| SEQ ID NO: 163 | 1399470 | 439260 | T26G10.1. [*Caenorhabditis elegans*.] |
| SEQ ID NO: 164 | 1403760 | 1049294 | Human KRAB zinc finger protein (ZNF177) mRNA, splicing variant, [human.] |
| SEQ ID NO: 165 | 1403772 | 1161343 | interleukin 17 receptor. [house mouse.] |
| SEQ ID NO: 166 | 1405404 | 1483143 | apolipoprotein E receptor 2 precursor. [human.] |
| SEQ ID NO: 167 | 140819 | 296460 | *H. sapiens* mRNA for ZNF11B. [human.] |
| SEQ ID NO: 168 | 1413041 | 1679667 | Human mitogen-activated kinase kinase kinase 5 (MAPKKK5) mRNA, [human.] |
| SEQ ID NO: 169 | 1413667 | 186798 | voltage-gated potassium channel. [human.] |
| SEQ ID NO: 170 | 1414780 | 1398905 | Rat brain mRNA for long type PB-cadherin, complete cds. [*Rattus norvegicus* (strain: Wistar) brain cDNA to mRNA, clone: B5.] |
| SEQ ID NO: 171 | 1415728 | 2145061 | *Homo sapiens* TTF-I interacting peptide 21 mRNA, partial cds. [human.] |
| SEQ ID NO: 172 | 1415866 | 340485 | *Homo sapiens* DNA-binding protein (ZNF) gene, partial cds. [*Homo sapiens* Placenta DNA.] |
| SEQ ID NO: 173 | 1416274 | 190222 | protein phosphatase 2A 72 kDa regulatory subunit. [human.] |
| SEQ ID NO: 174 | 1417215 | 2121307 | Human DNA sequence from 4PTEL, Huntington's Disease Region, [human.] |
| SEQ ID NO: 175 | 1418783 | 1021158 | *H. sapiens* CpG island DNA genomic Mse1 fragment, 197 clone, [human.] |
| SEQ ID NO: 176 | 1419071 | 1500558 | 2-hydroxyhepta-2,4-diene-1,7-dioate isomerase. [*Methanococcus jannaschii*.] |
| SEQ ID NO: 177 | 1419270 | 2077934 | Protein Kinase. [Norway rat.] |
| SEQ ID NO: 178 | 1419541 | 34339 | LDL-receptor related precursor (AA - 19 45 to). [human.] |
| SEQ ID NO: 179 | 1419783 | 902886 | Ksp-cadherin [*Oryctolagus cuniculus*] |
| SEQ ID NO: 180 | 1421907 | 340478 | DNA-binding protein. [human.] |

TABLE 1-continued

| SEQ ID NO: | | | |
|---|---|---|---|
| SEQ ID NO: 181 | 1422786 | 841318 | mutant sterol regulatory element binding protein-2 [*Cricetulus griseus*] |
| SEQ ID NO: 182 | 1427806 | 1518609 | FGF receptor activating protein FRAG1. [Norway rat.] |
| SEQ ID NO: 183 | 1429651 | 473969 | one of the members of sodium-glucose cotransporter family. [*Oryctolagus cuniculus.*] |
| SEQ ID NO: 184 | 1431066 | 1835659 | multidrug resistance-associated protein. [human.] |
| SEQ ID NO: 185 | 1440783 | 984114 | ribosome receptor [*Canis familiaris*] |
| SEQ ID NO: 186 | 1441850 | 204208 | GABA-A receptor delta subunit. [Norway rat.] |
| SEQ ID NO: 187 | 1443611 | 192371 | cyclic nucleotide phosphodiesterase. [house mouse.] |
| SEQ ID NO: 188 | 1445845 | 1103585 | laminin beta 2 chain. [human.] |
| SEQ ID NO: 189 | 1446171 | 1061253 | putative protein. [baker's yeast.] |
| SEQ ID NO: 190 | 1449092 | 558634 | *R. norvegicus* mRNA for protein phosphatase V. [Norway rat.] |
| SEQ ID NO: 191 | 1449207 | 488551 | zinc finger protein ZNF132. [human.] |
| SEQ ID NO: 192 | 1450036 | 32565 | *H. sapiens* hZNF3 (22) zn finger gene. [human.] |
| SEQ ID NO: 193 | 1450691 | 984305 | hPAK65 [*Homo sapiens*] |
| SEQ ID NO: 194 | 1452972 | 1335855 | Human 5'-AMP-activated protein kinase, gamma-1 subunit mRNA, [human.] |
| SEQ ID NO: 195 | 1454748 | 1854512 | ATP receptor. (human.) |
| SEQ ID NO: 196 | 1455911 | 595396 | *Rattus norvegicus* Edg-1 orphan receptor (edg-1) mRNA, complete cds. [rat.] |
| SEQ ID NO: 197 | 1458887 | 984114 | ribosome receptor [*Canis familiaris*] |
| SEQ ID NO: 198 | 1459432 | 1737178 | Human somatostatin receptor-like protein (SLC1) gene, complete cds. [human.] |
| SEQ ID NO: 199 | 1473889 | 1514568 | canalicular multidrug resistance protein. [human.] |
| SEQ ID NO: 200 | 1478125 | 468707 | *H. sapiens* OZF mRNA. [human.] |
| SEQ ID NO: 201 | 1478654 | 2076881 | Human putative endothelin receptor type B-like protein mRNA, [human.] |
| SEQ ID NO: 202 | 1484393 | 506800 | similar to protein kinases. [*Caenorhabditis elegans* strain = Bristol N2.] |
| SEQ ID NO: 203 | 1485091 | 1353416 | cyclin-dependent kinase 4. [human.] |
| SEQ ID NO: 204 | 148732 | 498730 | *H. sapiens* HZF6 mRNA for zinc finger protein. [human.] |
| SEQ ID NO: 205 | 1488082 | 1679772 | Bop1. [house mouse.] |
| SEQ ID NO: 206 | 1491965 | 1871168 | sodium channel 2. [human.] |
| SEQ ID NO: 207 | 149706 | 984114 | ribosome receptor [*Canis familiaris*] |
| SEQ ID NO: 208 | 1499408 | 202805 | *Rattus norvegicus* angiotensin/vasopressin receptor (AII/AVP) mRNA, [*Rattus norvegicus* cDNA to mRNA.] |
| SEQ ID NO: 209 | 150224 | 1657296 | *H. sapiens* CACNL1A4 gene, exon 37. [human.] |
| SEQ ID NO: 210 | 1506560 | 206809 | Rat pot. G protein coupled receptor (RTA) mRNA, complete cds. [Rat (strain Sprague Dawley) adult thoracic aorta, cDNA to mRNA] |
| SEQ ID NO: 211 | 1513769 | 160858 | zinc finger protein. [*Bradysia coprophila.*] |
| SEQ ID NO: 212 | 1513871 | 53612 | *M. musculus* of PCTAIRE-3 mRNA encoding protein kinase. [house mouse.] |
| SEQ ID NO: 213 | 1515432 | 179227 | ATP1A1. (human.) |
| SEQ ID NO: 214 | 1518859 | 1699163 | ETX1 {alternatively spliced} [human, retina, 4 Peptide, aa]. [human retina.] |
| SEQ ID NO: 215 | 1519420 | 1418625 | W04D2.1. [*Caenorhabditis elegans.*] |
| SEQ ID NO: 216 | 1520835 | 2062676 | inhibitor of apoptosis protein 2. [house mouse.] |
| SEQ ID NO: 217 | 1522516 | 182696 | Human cellular fibronectin mRNA. [Human cDNA to mRNA.] |
| SEQ ID NO: 218 | 1522554 | 914885 | unknown [*Schizosaccharomyces pombe*] |
| SEQ ID NO: 219 | 1524781 | 1143819 | *Mus musculus* MAP kinase kinase kinase (MEKK1) mRNA, partial cds. [house mouse.] |
| SEQ ID NO: 220 | 1525902 | INCYTE | N-type calcium channel alpha1 subunit [*Mus musculus*] |
| SEQ ID NO: 221 | 1525913 | 182080 | eosinophil major basic protein precursor. [human.] |
| SEQ ID NO: 222 | 1531264 | 1353501 | *Mus musculus* oocyte G protein gamma 7 subunit mRNA, partial cds. [house mouse strain = CF1, Harlan.] |
| SEQ ID NO: 223 | 1534444 | 1151259 | *Mus musculus* putative transmembrane receptor (frizzled 8) gene, [house mouse.] |
| SEQ ID NO: 224 | 1534638 | 438372 | *H. sapiens* mRNA for protein kinase C mu. [human.] |
| SEQ ID NO: 225 | 1535355 | 1754748 | GABAA receptor gamma 3 subunit [human, fetal brain, mRNA Partial, [human fetal brain.] |
| SEQ ID NO: 226 | 1542751 | 1906590 | Human sigma receptor mRNA, complete cds. [human.] |
| SEQ ID NO: 227 | 1552350 | 1107696 | Mi-2 protein. [human.] |
| SEQ ID NO: 228 | 1556277 | 2148923 | *Homo sapiens* helicase like protein 2 (DDX14) mRNA, complete cds. [human.] |
| SEQ ID NO: 229 | 1559036 | 204416 | fructose transporter. [Norway rat.] |
| SEQ ID NO: 230 | 1561663 | 1665760 | Human mRNA for KIAA0246 gene, partial cds. [*Homo sapiens* male bone marrow myeloblast cell_line: KG-1 cDNA to] |
| SEQ ID NO: 231 | 156196 | 206054 | cyclic nucleotide phosphodiesterase. [Norway rat.] |
| SEQ ID NO: 232 | 1562022 | 2182131 | Mouse mRNA for STK-1 (serine/threonine kinase), complete cds. [*Mus musculus* (strain: C57BL/6) adult testis cDNA to mRNA.] |
| SEQ ID NO: 233 | 1567861 | 1943802 | Similar to protein-tyrosine phosphatase. [*Caenorhabditis elegans* strain = Bristol N2.] |
| SEQ ID NO: 234 | 1568973 | 914885 | unknown [*Schizosaccharomyces pombe*] |
| SEQ ID NO: 235 | 1571294 | 285933 | Mel-18 protein. [human.] |

TABLE 1-continued

| SEQ ID NO: | | | |
|---|---|---|---|
| SEQ ID NO: 236 | 1571739 | 11140 | RAS2 protein. [*Hydra magnipapillata*.] |
| SEQ ID NO: 237 | 1577179 | 1293574 | transcriptional repressor protein. [fruit fly.] |
| SEQ ID NO: 238 | 1582344 | 1835658 | Human multidrug resistance-associated protein (MRP) mRNA, complete [human.] |
| SEQ ID NO: 239 | 158840 | 1620663 | Human phogrin mRNA, complete cds. [human.] |
| SEQ ID NO: 240 | 158909 | 299705 | BL34 = B cell activation gene [human, 1 Peptide, aa]. [human.] |
| SEQ ID NO: 241 | 1594203 | 312151 | *H. sapiens* SOX-12 gene. [human.] |
| SEQ ID NO: 242 | 1595261 | 1377924 | Human calcium ATPase isoform 3x/a mRNA, complete cds. [human.] |
| SEQ ID NO: 243 | 1595550 | 510884 | retinal degeneration B protein. [fruit fly.] |
| SEQ ID NO: 244 | 1599448 | 506800 | similar to protein kinases. [*Caenorhabditis elegans* strain = Bristol N2.] |
| SEQ ID NO: 245 | 1602048 | 2076750 | Human phosphatidylinositol 3-kinase delta catalytic subunit mRNA, [human.] |
| SEQ ID NO: 246 | 160377 | 903599 | Krueppel-type zinc finger protein [*Homo sapiens*] |
| SEQ ID NO: 247 | 1609593 | 307180 | P-glycoprotein. [human.] |
| SEQ ID NO: 248 | 1611858 | 1857330 | Human SPS1/STE20 homolog KHS1 mRNA, complete cds. [human.] |
| SEQ ID NO: 249 | 1613615 | 179503 | Human bone morphogenetic protein-2B (BMP-2B) mRNA. [Human osteosarcoma cell line U-2 OS, cDNA to mRNA, clone hBMP-2B.] |
| SEQ ID NO: 250 | 1614664 | 219430 | alpha-fetoprotein enhancer binding protein. [human.] |
| SEQ ID NO: 251 | 1617511 | 56428 | Rat mRNA for insulin like growth factor II precursor (prepro rIGF [Norway rat.] |
| SEQ ID NO: 252 | 1620089 | 1491710 | alpha subunit; forms heterodimer with NC2 alpha/Dr1. [human.] |
| SEQ ID NO: 253 | 1627314 | 406057 | *Mus musculus* MAST205 protein kinase mRNA, complete cds. [house mouse.] |
| SEQ ID NO: 254 | 1627393 | 1914877 | breast tumor autoantigen. [human.] |
| SEQ ID NO: 255 | 1631444 | 29730 | Human mRNA for c-cb1 proto-oncogene. [human.] |
| SEQ ID NO: 256 | 1633025 | 868001 | chicken cadherin-7 [*Gallus gallus*] |
| SEQ ID NO: 257 | 1638409 | 2062695 | Human Ro/SSA ribonucleoprotein homolog (RoRet) mRNA, complete cds. [human.] |
| SEQ ID NO: 258 | 1640136 | 33969 | IRLB. [human.] |
| SEQ ID NO: 259 | 1644169 | 165527 | telokin. [European rabbit.] |
| SEQ ID NO: 260 | 1650213 | 1685127 | *Mus musculus* interferon regulatory factor 6 (mirf6) mRNA, complete [house mouse.] |
| SEQ ID NO: 261 | 1650519 | 285995 | KIAA0001. [human.] |
| SEQ ID NO: 262 | 1661781 | 438372 | *H. sapiens* mRNA for protein kinase C mu. [human.] |
| SEQ ID NO: 263 | 1663527 | 695369 | put. 26S protease subunit [*Sus scrofa*] |
| SEQ ID NO: 264 | 166395 | 29505 | general transcription factor. [human.] |
| SEQ ID NO: 265 | 1665830 | 2076604 | phosphoinositide 3-kinase. [human.] |
| SEQ ID NO: 266 | 1683253 | 1161229 | *Rattus norvegicus* protocadherin-3 (pcdh3) mRNA, complete cds. [*Rattus norvegicus* (strain Sprague-Dawley) (clone: 43) adult brain] |
| SEQ ID NO: 267 | 1683908 | 182181 | excision repair protein. [human.] |
| SEQ ID NO: 268 | 1687189 | 35919 | *H. sapiens* REC1L mRNA. [human.] |
| SEQ ID NO: 269 | 1689047 | 1256017 | sodium channel 1. [human.] |
| SEQ ID NO: 270 | 1692213 | 1790211 | peptidyl-prolyl cis-trans isomerase C. [*Escherichia coli*.] |
| SEQ ID NO: 271 | 1695770 | 31848 | *H. sapiens* alpha-2 strychnine binding subunit of inhibitory glycine [human.] |
| SEQ ID NO: 272 | 1696636 | 1827449 | *Homo sapiens* mRNA for VRK1, complete cds. [*Homo sapiens* fetal liver cDNA to mRNA.] |
| SEQ ID NO: 273 | 1698367 | 1841339 | *Homo sapiens* mRNA for NB thymosin beta, complete cds. [*Homo sapiens* Neuroblastoma cell_line: IMR-32 cDNA to mRNA.] |
| SEQ ID NO: 274 | 1698521 | 1199548 | 23 ORF. [baker's yeast.] |
| SEQ ID NO: 275 | 170173 | 995916 | GTP-binding regulatory protein gamma-6 subunit [*Homo sapiens*] |
| SEQ ID NO: 276 | 1711051 | 548081 | Human guanine nucleotide regulatory protein (NET1) mRNA, complete [human.] |
| SEQ ID NO: 277 | 171185 | 311341 | gamma-COP. [cow.] |
| SEQ ID NO: 278 | 1714778 | 1206009 | IL-1Rrp. [human.] |
| SEQ ID NO: 279 | 1715239 | 297412 | thrombin inhibitor. [human.] |
| SEQ ID NO: 280 | 171540 | 2098821 | *Homo sapiens* chromosome 16 BAC clone CIT987SK-334D11 complete [human.] |
| SEQ ID NO: 281 | 1718820 | 289614 | homology with glucose induced repressor, GRR1; putative. [*Caenorhabditis elegans*.] |
| SEQ ID NO: 282 | 1719418 | 1487873 | Phosphatidic acid phosphatase. [house mouse.] |
| SEQ ID NO: 283 | 1721611 | 2073569 | cDNA encoding nuclear chloride ion channel. [human.] |
| SEQ ID NO: 284 | 1722180 | 163952 | histamine H2 receptor. [*Canis sp*.] |
| SEQ ID NO: 285 | 1723064 | 1430907 | epithelial basolatelar chloride conductance regulator. [European rabbit.] |
| SEQ ID NO: 286 | 1723675 | 1710275 | Human 237 clone mRNA, complete cds. [human.] |
| SEQ ID NO: 287 | 1732084 | 1794206 | Human kinase Myt1 (Myt1) mRNA, complete cds. [human.] |
| SEQ ID NO: 288 | 1734452 | 340084 | undulin 2. [human.] |
| SEQ ID NO: 289 | 173693 | 29505 | general transcription factor. [human.] |

TABLE 1-continued

| SEQ ID NO: | | | |
|---|---|---|---|
| SEQ ID NO: 290 | 1737775 | 1184066 | calcium-activated chloride channel. [cow.] |
| SEQ ID NO: 291 | 1746096 | 587145 | *H. sapiens* BAT1 mRNA for nuclear RNA helicase (DEAD family). [human.] |
| SEQ ID NO: 292 | 1749008 | 181179 | Human cathepsin D mRNA, complete cds. [Human kidney, cDNA to mRNA, clone pHKCD45; hepatoma cell line G2] |
| SEQ ID NO: 293 | 1751294 | 1679601 | *H. sapiens* mRNA for G protein-coupled receptor Edg-2. [human.] |
| SEQ ID NO: 294 | 1755202 | 971464 | K-Cl cotransporter [*Homo sapiens*] |
| SEQ ID NO: 295 | 176843 | 520878 | serine/threonine protein kinase. [house mouse.] |
| SEQ ID NO: 296 | 1785924 | 1754694 | magnesium-dependent calcium inhibitable phosphatase. [cattle.] |
| SEQ ID NO: 297 | 179527 | 1039419 | JAK3B. [human.] |
| SEQ ID NO: 298 | 1796032 | 1620663 | Human phogrin mRNA, complete cds. [human.] |
| SEQ ID NO: 299 | 1801513 | 1871203 | Human 16 chromosome BAC clone CIT987SK-363E6, complete sequence. [human.] |
| SEQ ID NO: 300 | 1802032 | 1565278 | ADP-ribosylation factor. [malaria parasite.] |
| SEQ ID NO: 301 | 1802436 | 1487872 | House mouse; *Musculus domesticus* kidney mRNA for Phosphatidic acid [*Mus musculus* kidney cDNA to mRNA.] |
| SEQ ID NO: 302 | 1802489 | 193910 | Mouse homeobox protein (Hox-1.11) gene, complete cds. [*Mus musculus* (strain ICR Swiss) (library: lambda Gem-11) adult] |
| SEQ ID NO: 303 | 1802982 | 105 | epsilon subunit of ATP synthetase [*Bos taurus*] |
| SEQ ID NO: 304 | 1811958 | 1770395 | *H. sapiens* EDG-3 gene. [human.] |
| SEQ ID NO: 305 | 1812162 | 1161306 | autophosphorylation sites at 2 tyrosine and 2 serine. [African clawed frog.] |
| SEQ ID NO: 306 | 1812894 | 1016711 | *Rattus norvegicus* Fos-related antigen mRNA, complete cds. [Norway rat strain = F344.] |
| SEQ ID NO: 307 | 1813005 | 157196 | D-ets-4 DNA binding domain protein. [fruit fly.] |
| SEQ ID NO: 308 | 1814190 | 1136139 | *H. sapiens* mRNA for coronin. [human.] |
| SEQ ID NO: 309 | 1816626 | 871433 | rod cGMP phosphodiesterase beta-subunit [*Mus musculus*] |
| SEQ ID NO: 310 | 1819167 | 186757 | Human protein kinase mRNA. [Human adult lymphocyte T cell, cDNA to mRNA.] |
| SEQ ID NO: 311 | 1819255 | 1589737 | Human helix-loop-helix protein CHUK mRNA, complete cds. [human.] |
| SEQ ID NO: 312 | 184111 | 193352 | finger protein (put.); putative. [house mouse.] |
| SEQ ID NO: 313 | 1843692 | 190688 | pancreatic secretory trypsin inhibitor. [human.] |
| SEQ ID NO: 314 | 184712 | 1256362 | zinc finger protein. [house mouse.] |
| SEQ ID NO: 315 | 1849449 | 1698659 | potassium channel ROM-K3. [human.] |
| SEQ ID NO: 316 | 1850226 | 433445 | R2D5 antigen. [European rabbit.] |
| SEQ ID NO: 317 | 1850885 | 1326113 | calcium influx channel. [human.] |
| SEQ ID NO: 318 | 1853144 | 2104784 | *Mus musculus* 9ORF binding protein 1 (9BP-1) mRNA, partial cds. [house mouse.] |
| SEQ ID NO: 319 | 1853379 | 606962 | *Rattus norvegicus* oxytocin receptor (OTR) gene [Norway rat.] |
| SEQ ID NO: 320 | 1854243 | 2039275 | males-absent on the first. [fruit fly.] |
| SEQ ID NO: 321 | 1854478 | 156418 | putative. [*Caenorhabditis elegans*.] |
| SEQ ID NO: 322 | 1859317 | 1161099 | *Mus musculus* (clone HIC-53) hydrogen peroxide-inducible protein [*Mus musculus* (clone: HIC-53) embryo calvariagag cDNA to mRNA.] |
| SEQ ID NO: 323 | 1870882 | 487418 | actin filament-associated protein. [chicken.] |
| SEQ ID NO: 324 | 1872615 | 35014 | Human melanoma mRNA for nck protein, showing homology to src. [human.] |
| SEQ ID NO: 325 | 1880501 | 395085 | ATP receptor P2Y1. [chicken.] |
| SEQ ID NO: 326 | 1881130 | 1763665 | Snk interacting protein 2-28. [human.] |
| SEQ ID NO: 327 | 1888801 | 206809 | Rat pot. G protein coupled receptor (RTA) mRNA, complete cds. [Rat (strain Sprague Dawley) adult thoracic aorta, cDNA to mRNA,] |
| SEQ ID NO: 328 | 189981 | 1526977 | *H. sapiens* mRNA for ryanodine receptor 2. [human.] |
| SEQ ID NO: 329 | 1907628 | 1888565 | *Mus musculus* protein phosphatase 1 binding protein PTG mRNA, [house mouse.] |
| SEQ ID NO: 330 | 1909132 | 307158 | mas protein. [human.] |
| SEQ ID NO: 331 | 1911587 | 1220173 | dual specificity phosphatase. [Norway rat.] |
| SEQ ID NO: 332 | 1913754 | 164763 | dihydropryridine-sensitive calcium channel alpha-2 subunit. [European rabbit.] |
| SEQ ID NO: 333 | 1916151 | 1524004 | serine/threonine protein kinase. [fruit fly.] |
| SEQ ID NO: 334 | 1917286 | 1842087 | Human tyrosine phosphatase-like protein homolog hSTYXb mRNA, [human.] |
| SEQ ID NO: 335 | 1920752 | 1514568 | canalicular multidrug resistance protein. [human.] |
| SEQ ID NO: 336 | 193629 | 763534 | secretin receptor [*Homo sapiens*] |
| SEQ ID NO: 337 | 194510 | 340478 | DNA-binding protein. [human.] |
| SEQ ID NO: 338 | 195647 | 642800 | PP2C [*Paramecium tetraurelia*] |
| SEQ ID NO: 339 | 1961860 | 1747370 | *H. sapiens* mRNA for putative GABA-gated chloride channel. [human.] |
| SEQ ID NO: 340 | 1963281 | 595421 | protein kinase. [house mouse.] |
| SEQ ID NO: 341 | 1963772 | 508233 | Rca1p. [baker's yeast.] |
| SEQ ID NO: 342 | 196640 | 505548 | zinc-finger protein (ZNFpT7). [human.] |

TABLE 1-continued

| SEQ ID NO: | | | |
|---|---|---|---|
| SEQ ID NO: 343 | 1966404 | 2108051 | Human cGMP-stimulated 3',5'-cyclic nucleotide phosphodiesterase [human.] |
| SEQ ID NO: 344 | 1971037 | 181949 | endothelial differentiation protein (edg-1). [human.] |
| SEQ ID NO: 345 | 1973931 | 1407587 | MEK Kinase 3. [house mouse.] |
| SEQ ID NO: 346 | 197500 | 454324 | *H. sapiens* ZNF81 gene. [human.] |
| SEQ ID NO: 347 | 1989157 | 387675 | protocadherin 42. [human.] |
| SEQ ID NO: 348 | 1989493 | 178437 | Human phosphatase 2A mRNA, partial cds. [human.] |
| SEQ ID NO: 349 | 1989936 | 180686 | Human 2',3'-cyclic nucleotide 3'-phosphodiesterase mRNA, complete [Human glioma (cell line U-251MG), cDNA to mRNA.] |
| SEQ ID NO: 350 | 1992818 | 1806048 | nuclear DNA helicase II. [human.] |
| SEQ ID NO: 351 | 1992915 | 1941925 | retinal epithelial membrane protein. [chicken.] |
| SEQ ID NO: 352 | 1994216 | 387675 | protocadherin 42. [human.] |
| SEQ ID NO: 353 | 1996651 | 1054887 | novel transcript; similar to transcription factors activation [human.] |
| SEQ ID NO: 354 | 1998162 | 190459 | Human endomembrane proton pump subunit mRNA, complete cds. [Human kidney, cDNA to mRNA.] |
| SEQ ID NO: 355 | 2011686 | 1597729 | serine threonine kinase. [house mouse.] |
| SEQ ID NO: 356 | 2012970 | 20756 | RAS-related GTP-binding protein. [pea.] |
| SEQ ID NO: 357 | 2017571 | 1550782 | *M. musculus* mRNA for transcription factor BARX1. [house mouse.] |
| SEQ ID NO: 358 | 2018356 | 1656001 | rit. [human.] |
| SEQ ID NO: 359 | 2018536 | 1504145 | growth hormone secretagogue receptor type 1a. [pig.] |
| SEQ ID NO: 360 | 2023607 | 558349 | host cell factor. [human.] |
| SEQ ID NO: 361 | 2024210 | 212485 | ovoinhibitor. [chicken.] |
| SEQ ID NO: 362 | 2028257 | 307184 | *Homo sapiens* ERK activator kinase (MEK2) mRNA. [*Homo sapiens* cDNA to mRNA.] |
| SEQ ID NO: 363 | 2029134 | 517365 | *R. norvegicus* olp4 mRNA. [Norway rat.] |
| SEQ ID NO: 364 | 2039628 | 205038 | *Rattus norvegicus* K+ channel mRNA, sequence. [*Rattus norvegicus* adult brain cDNA to mRNA.] |
| SEQ ID NO: 365 | 2047048 | 1809219 | human K+ channel beta 2 subunit mRNA, complete cds. [human.] |
| SEQ ID NO: 366 | 2049369 | 207464 | transferrin receptor. [Norway rat.] |
| SEQ ID NO: 367 | 2054141 | 1397246 | coded for by *C. elegans* cDNA yk112f3.5; coded for by *C. elegans* [*Caenorhabditis elegans.*] |
| SEQ ID NO: 368 | 2054814 | 192644 | Mouse connexin 31.1 (Cx31.1) gene, complete cds, 8 clone. [*Mus musculus* (strain GR) (library: charon 4A of B. Groner) adult] |
| SEQ ID NO: 369 | 2055179 | 474283 | *Mus musculus* BALB/c zinc-finger protein Blimp-1 mRNA, complete cds. [house mouse.] |
| SEQ ID NO: 370 | 2055790 | 1399804 | Human Bcl2, p53 binding protein Bbp/53BP2 (BBP/53BP2) mRNA, [human.] |
| SEQ ID NO: 371 | 2056018 | 1403708 | *Rattus norvegicus* furosemide-sensitive K-Cl cotransporter (KCC2) [Norway rat.] |
| SEQ ID NO: 372 | 2059915 | 541667 | musashi. [fruit fly.] |
| SEQ ID NO: 373 | 2060327 | 263673 | F1Fo-ATPase subunit e [mice, Balb/c, Peptide, 71 aa]. [*Mus sp.* Balb/c.] |
| SEQ ID NO: 374 | 2060769 | 212659 | skeletal muscle C-protein. [chicken.] |
| SEQ ID NO: 375 | 2061942 | 807817 | putative RNA helicase HRH1 [*Homo sapiens*] |
| SEQ ID NO: 376 | 2062218 | 806296 | prIL-16 = putative interleukin-16 precursor [*Homo sapiens*] |
| SEQ ID NO: 377 | 2069502 | 171114 | ATPase. [baker's yeast.] |
| SEQ ID NO: 378 | 2077640 | 1906041 | Human embryonic ectoderm development protein homolog (eed) mRNA, [human.] |
| SEQ ID NO: 379 | 2079292 | 439260 | T26G10.1. [*Caenorhabditis elegans.*] |
| SEQ ID NO: 380 | 2080608 | 1504088 | DNA-binding protein. [house mouse.] |
| SEQ ID NO: 381 | 2081193 | 220418 | glutamate receptor channel subunit delta-1. [house mouse.] |
| SEQ ID NO: 382 | 2081690 | 1857160 | Human zinc finger transcription factor hEZF (EZF) mRNA, complete [human.] |
| SEQ ID NO: 383 | 2087413 | 606948 | neuron-restrictive silencer factor. [human.] |
| SEQ ID NO: 384 | 2088215 | 1669383 | Human BAC clone RG067M09 7 from-7q22, complete sequence. [human.] |
| SEQ ID NO: 385 | 2096740 | 2062691 | Human sodium phosphate transporter (NPT4) mRNA, complete cds. [human.] |
| SEQ ID NO: 386 | 2098429 | 1381810 | skeletal muscle LIM-protein SLIM2. [human.] |
| SEQ ID NO: 387 | 2102405 | 348238 | Human mRNA, complete cds. [*Homo sapiens* cDNA to mRNA.] |
| SEQ ID NO: 388 | 2102713 | 1840052 | Human liver GABA transport protein mRNA, 3' end. [human.] |
| SEQ ID NO: 389 | 2106395 | 289622 | homology with ATP-dependent RNA helicase; putative. [*Caenorhabditis elegans.*] |
| SEQ ID NO: 390 | 2108581 | 944911 | inositol polyphosphate 4-phosphatase [*Homo sapiens*] |
| SEQ ID NO: 391 | 2108752 | 1507672 | GS3955. [human.] |
| SEQ ID NO: 392 | 2109526 | 1628399 | inter-alpha-trypsin inhibitor heavy chain H3. [human.] |
| SEQ ID NO: 393 | 2109849 | 531750 | probable mitochondrial protein. [baker's yeast.] |
| SEQ ID NO: 394 | 2110163 | 1418484 | C54G4.1. [*Caenorhabditis elegans.*] |

TABLE 1-continued

| SEQ ID NO: | | | |
|---|---|---|---|
| SEQ ID NO: 395 | 2110277 | 4178 | PIF gene product (AA 1-857). [baker's yeast.] |
| SEQ ID NO: 396 | 2111542 | 2062399 | calcium calmodulin dependent kinase CPG16. [Norway rat.] |
| SEQ ID NO: 397 | 2113436 | 1508828 | Human seven in absentia homolog mRNA, complete cds. [human.] |
| SEQ ID NO: 398 | 2114703 | 525195 | *C. griseus* epsilon-COP mRNA. [Chinese hamster.] |
| SEQ ID NO: 399 | 2114943 | 193979 | Hox-3.1 protein. [house mouse.] |
| SEQ ID NO: 400 | 2117559 | 289614 | homology with glucose induced repressor, GRR1; putative. [*Caenorhabditis elegans.*] |
| SEQ ID NO: 401 | 2118071 | 450553 | ORF YKR413. [baker's yeast.] |
| SEQ ID NO: 402 | 2121021 | 625041 | basic domain/leucine zipper transcription factor [*Mus musculus*] |
| SEQ ID NO: 403 | 2121175 | 1065718 | tenascin-C. [zebrafish.] |
| SEQ ID NO: 404 | 2121278 | 217399 | limulus factor C precursor. [Japanese horseshoe crab.] |
| SEQ ID NO: 405 | 2121285 | 54257 | Mouse mRNA for talin. [house mouse.] |
| SEQ ID NO: 406 | 2121593 | 924921 | branched-chain alpha-ketoacid dehydrogenase kinase [*Rattus norvegicus*] |
| SEQ ID NO: 407 | 2122108 | 55818 | Rat mRNA for beta COP. [Norway rat.] |
| SEQ ID NO: 408 | 2122627 | 1568629 | *Mus musculus* nuclear LIM interactor (NLI) mRNA, complete cds. [house mouse.] |
| SEQ ID NO: 409 | 2123679 | 206130 | cyclic nucleotide phosphodiesterase. [Norway rat.] |
| SEQ ID NO: 410 | 2124153 | 1929896 | Human stat-like protein (Fe65) mRNA, complete cds. [human.] |
| SEQ ID NO: 411 | 2124608 | 1881851 | SOX5 = Sry-related HMG box gene {alternatively spliced} [human, [human testis.] |
| SEQ ID NO: 412 | 2125658 | 182923 | gamma-aminobutyric acid receptor beta-1 subunit. [human.] |
| SEQ ID NO: 413 | 2132279 | 1262435 | put. 26S protease subunit. [pig.] |
| SEQ ID NO: 414 | 2132361 | 179412 | DNA-binding factor. [human.] |
| SEQ ID NO: 415 | 2137141 | 2182130 | G protein beta 5 subunit. [Norway rat.] |
| SEQ ID NO: 416 | 2137420 | 173142 | zinc finger protein. [baker's yeast.] |
| SEQ ID NO: 417 | 2137838 | 1914169 | F23B2.4. [*Caenorhabditis elegans.*] |
| SEQ ID NO: 418 | 2148792 | 1373393 | Human zinc finger protein (LD5-1) mRNA, complete cds. [human.] |
| SEQ ID NO: 419 | 214915 | 2181950 | stress-activated protein kinase-3. [house mouse.] |
| SEQ ID NO: 420 | 2150261 | 914027 | neurotransmitter transporter rB21a [rat] |
| SEQ ID NO: 421 | 2150668 | 202861 | Rat alternatively spliced mRNA. [*Rattus norvegicus* (strain Sprague-Dawley) male stomach and testis] |
| SEQ ID NO: 422 | 2153874 | 802104 | PP1M M110 = protein phosphatase [rat] |
| SEQ ID NO: 423 | 2155287 | 881961 | NEX-1 [*Mus musculus*] |
| SEQ ID NO: 424 | 2155484 | 2058550 | Human leukemogenic homolog protein (MEIS1) mRNA, complete cds. [human.] |
| SEQ ID NO: 425 | 215793 | 1613851 | Human zinc finger protein zfp2 (zf2) mRNA, partial cds. [human.] |
| SEQ ID NO: 426 | 215814 | 263348 | zinc finger = ZNF126 [human, Peptide Partial, 98 aa]. [human.] |
| SEQ ID NO: 427 | 2169507 | 202861 | Rat alternatively spliced mRNA. [*Rattus norvegicus* (strain Sprague-Dawley) male stomach and testis] |
| SEQ ID NO: 428 | 2170402 | 1772561 | transcription factor. [human.] |
| SEQ ID NO: 429 | 2171432 | 1785642 | *H. sapiens* mRNA for dinG gene. [human.] |
| SEQ ID NO: 430 | 2171634 | 1613857 | Human zinc finger protein zfp47 (zf47) mRNA, partial cds. [human.] |
| SEQ ID NO: 431 | 2171638 | 1504028 | similar to putative ATP-dependent RNA helicase K03H1.2 of [human.] |
| SEQ ID NO: 432 | 2172576 | 1872545 | *Mus musculus* NIK mRNA, complete cds. [house mouse.] |
| SEQ ID NO: 433 | 2172609 | 1488262 | Human putative serine/threonine protein kinase PRK (prk) mRNA, [human.] |
| SEQ ID NO: 434 | 2173757 | 897914 | RNA helicase [*Rattus norvegicus*] |
| SEQ ID NO: 435 | 2174728 | 1016711 | *Rattus norvegicus* Fos-related antigen mRNA, complete cds. [Norway rat strain = F344.] |
| SEQ ID NO: 436 | 2175339 | 1302657 | *Homo sapiens* Xq28 genomic DNA in the region of the L1CAM locus [human.] |
| SEQ ID NO: 437 | 2176878 | 206885 | *Rattus rattus* sec61 homologue mRNA, complete cds. [*Rattus rattus* liver cDNA to mRNA.] |
| SEQ ID NO: 438 | 2181022 | 506800 | similar to protein kinases. [*Caenorhabditis elegans* strain = Bristol N2.] |
| SEQ ID NO: 439 | 2182105 | 2108052 | PDE2A3. [human.] |
| SEQ ID NO: 440 | 2185847 | 703420 | glucose transporter type 3 [*Ovis aries*] |
| SEQ ID NO: 441 | 2187310 | 307516 | transducin-like enhancer protein. [human.] |
| SEQ ID NO: 442 | 2190641 | 516011 | Human PINCH protein mRNA, complete cds. [human.] |
| SEQ ID NO: 443 | 2191455 | 1022955 | membrane glycoprotein. [Norway rat.] |
| SEQ ID NO: 444 | 2194081 | 1835659 | multidrug resistance-associated protein. [human.] |
| SEQ ID NO: 445 | 2194122 | 1004315 | GCD14 gene product. [baker's yeast.] |
| SEQ ID NO: 446 | 219612 | 487784 | Human zinc finger protein ZNF136. [human.] |

TABLE 1-continued

| SEQ ID NO: 447 | 2197276 | 685170 | protocadherin 42 [*Homo sapiens*] |
| SEQ ID NO: 448 | 2198819 | 29849 | cell division kinase. CDC2 homolog. [human.] |
| SEQ ID NO: 449 | 2200254 | 1835658 | Human multidrug resistance-associated protein (MRP) mRNA, complete [human.] |
| SEQ ID NO: 450 | 2202505 | 2062475 | TNF-stimulated gene 6 protein. [house mouse.] |
| SEQ ID NO: 451 | 221058 | 38016 | zinc finger protein [*Homo sapiens*] |
| SEQ ID NO: 452 | 2211507 | 1806048 | nuclear DNA helicase II. [human.] |
| SEQ ID NO: 453 | 2214140 | 1871531 | protein-tyrosine-phosphatase. [human.] |
| SEQ ID NO: 454 | 2219040 | 1865779 | largest subunit of RNA polymerase I (A). [fruit fly.] |
| SEQ ID NO: 455 | 2224854 | 35920 | REC1L gene product. [human.] |
| SEQ ID NO: 456 | 222689 | 1785654 | neuroserpin. [human.] |
| SEQ ID NO: 457 | 2228229 | 903595 | zinc finger protein ZNF133 [*Homo sapiens*] |
| SEQ ID NO: 458 | 2228712 | 202864 | [Rat alternatively spliced mRNA.], gene product. [Norway rat.] |
| SEQ ID NO: 459 | 2229049 | 538152 | *Rattus norvegicus* general vesicular transport factor p115 mRNA, [Norway rat.] |
| SEQ ID NO: 460 | 2230457 | 475207 | *M. musculus* mRNA for testin. [house mouse.] |
| SEQ ID NO: 461 | 2231705 | 475208 | testin. [house mouse.] |
| SEQ ID NO: 462 | 2231958 | 306479 | calcium/calmodulin-dependent protein kinase. [human.] |
| SEQ ID NO: 463 | 2232535 | 1016712 | Fos-related antigen. [Norway rat.] |
| SEQ ID NO: 464 | 2233388 | 34286 | *H. sapiens* gene for lecithin-cholesterol acyltransferase (LCAT). [human.] |
| SEQ ID NO: 465 | 2234456 | 182181 | excision repair protein. [human.] |
| SEQ ID NO: 466 | 2235851 | 439260 | T26G10.1. [*Caenorhabditis elegans*.] |
| SEQ ID NO: 467 | 2237527 | 1929896 | Human stat-like protein (Fe65) mRNA, complete cds. [human.] |
| SEQ ID NO: 468 | 2239527 | 311341 | gamma-COP. [cow.] |
| SEQ ID NO: 469 | 2240356 | 1277082 | signaling inositol polyphosphate 5 phosphatase SIP-145. [human.] |
| SEQ ID NO: 470 | 2240520 | 508528 | myocyte nuclear factor. [house mouse.] |
| SEQ ID NO: 471 | 2240612 | 206718 | zinc finger protein. [Norway rat.] |
| SEQ ID NO: 472 | 2243209 | 158641 | toll protein. [fruit fly.] |
| SEQ ID NO: 473 | 2243494 | 1353239 | putative RNA helicase A. [thale cress.] |
| SEQ ID NO: 474 | 2252446 | 913246 | nucleoporin p62 homolog [rat] |
| SEQ ID NO: 475 | 2254533 | 510292 | *H. sapiens* DNA sequence 5′flanking minisatellite D5S110. [human.] |
| SEQ ID NO: 476 | 2257828 | 482808 | epidermal surface antigen. [house mouse.] |
| SEQ ID NO: 477 | 2258413 | 1020486 | *H. sapiens* CpG island DNA genomic Mse1 fragment, 117 clone, [human.] |
| SEQ ID NO: 478 | 2258521 | 1685069 | sushi-repeat-containing protein precursor. [human.] |
| SEQ ID NO: 479 | 2258794 | 556219 | transcription regulator. [house mouse.] |
| SEQ ID NO: 480 | 2259652 | 404035 | frequenin. [fruit fly.] |
| SEQ ID NO: 481 | 2260261 | 311341 | gamma-COP. [cow.] |
| SEQ ID NO: 482 | 2260639 | 1161230 | protocadherin-3. [Norway rat.] |
| SEQ ID NO: 483 | 2260826 | 452518 | Human mRNA for KIAA0043 gene, complete cds. [*Homo sapiens* male myeloblast cel_line KG-1 cDNA to mRNA.] |
| SEQ ID NO: 484 | 2261160 | 292495 | Human global transcription activator homologous sequence mRNA, [*Homo sapiens* fibroblast cDNA to mRNA.] |
| SEQ ID NO: 485 | 226152 | 1791003 | macrophage inflammatory protein 3 beta. [human.] |
| SEQ ID NO: 486 | 2262662 | 1568629 | *Mus musculus* nuclear LIM interactor (NLI) mRNA, complete cds. [house mouse.] |
| SEQ ID NO: 487 | 2263527 | 4178 | PIF gene product (AA 1-857). [baker's yeast.] |
| SEQ ID NO: 488 | 2263965 | 414797 | pyruvate dehydrogenase phosphatase. [cow.] |
| SEQ ID NO: 489 | 2269765 | 206809 | Rat pot. G protein coupled receptor (RTA) mRNA, complete cds. [Rat (strain Sprague Dawley) adult thoracic aorta, cDNA to mRNA,] |
| SEQ ID NO: 490 | 2271162 | 204988 | inositol 1,4,5-triphosphate 3-kinase. [Norway rat.] |
| SEQ ID NO: 491 | 2271275 | 475207 | *M. musculus* mRNA for testin. [house mouse.] |
| SEQ ID NO: 492 | 2272231 | 606972 | protein phosphatase. [human] |
| SEQ ID NO: 493 | 2272243 | 841317 | SRD-2 mutant sterol r [*Cricetulus griseus*] |
| SEQ ID NO: 494 | 2272559 | 1575662 | *Rattus norvegicus* calcium-activated potassium channel rSK2 (SK) [Norway rat.] |
| SEQ ID NO: 495 | 2272739 | 198460 | Mouse immune suppressor factor TJ6 mRNA, complete cds. [Mouse (BALB/c, haplotype H-2-d) A helper T-cell hybridoma cell line] |
| SEQ ID NO: 496 | 2274281 | 35768 | polypirimidine tract binding protein. [human.] |

TABLE 1-continued

| SEQ ID NO: 497 | 2276067 | 289745 | homology with xnf7 gene product of *Xenopus laevis*; putative. [*Caenorhabditis elegans.*] |
| SEQ ID NO: 498 | 2276968 | 1930931 | *Homo sapiens* 1 (subclone from P1 H55) DNA sequence, complete [*Homo sapiens* (Subclones in pOT2 from P1 clone H55) DNA.] |
| SEQ ID NO: 499 | 2277516 | 1699163 | ETX1 {alternatively spliced} [human, retina, 4 Peptide, aa]. [human retina.] |
| SEQ ID NO: 500 | 2278671 | 862419 | protein kinase [*Drosophila melanogaster*] |
| SEQ ID NO: 501 | 2278736 | 436563 | *Mus musculus* GTP-binding protein (mSara) homologue mRNA, complete [*Mus musculus* (strain LAF1) cDNA to mRNA.] |
| SEQ ID NO: 502 | 2278826 | 1945271 | protein phosphatase 6. [human.] |
| SEQ ID NO: 503 | 2278920 | 476103 | mago nashi protein. [fruit fly.] |
| SEQ ID NO: 504 | 2279267 | 293754 | odorant receptor. [house mouse.] |
| SEQ ID NO: 505 | 2279903 | 1749794 | serine/threonine protein kinase. [human.] |
| SEQ ID NO: 506 | 2284088 | 1373393 | Human zinc finger protein (LD5-1) mRNA, complete cds. [human.] |
| SEQ ID NO: 507 | 2285674 | 2108051 | Human cGMP-stimulated 3',5'-cyclic nucleotide phosphodiesterase [human.] |
| SEQ ID NO: 508 | 2287624 | 1944613 | *R. norvegicus* mRNA for D-3-phosphoglycerate dehydrogenase. [Norway rat.] |
| SEQ ID NO: 509 | 2287955 | 517446 | vacuolar H-ATPase subunit D. [gaur.] |
| SEQ ID NO: 510 | 2288091 | 57560 | integrase-like protein, APP interacting protein. [black rat.] |
| SEQ ID NO: 511 | 2289257 | 256854 | nek1 = serine/threonine- and tyrosine-specific protein kinase [mice, [*Mus sp.* erythroleukemia cells.] |
| SEQ ID NO: 512 | 2289873 | 298323 | sodium-dependent neurotransmitter transporter {clone v7-3-2} [rats, [*Rattus sp.* Sprague Dawley ventral midbrain.] |
| SEQ ID NO: 513 | 2290031 | 1079734 | citron. [house mouse.] |
| SEQ ID NO: 514 | 2290347 | 288964 | *R. norvegicus* nup155 gene. [Norway rat.] |
| SEQ ID NO: 515 | 2291504 | 498735 | *H. sapiens* HZF9 mRNA for zinc finger protein. [human.] |
| SEQ ID NO: 516 | 2291661 | 511010 | *H. sapiens* hZNF6 (22) zn finger gene. [human.] |
| SEQ ID NO: 517 | 2292150 | 1546778 | *Mus musculus* p53-associated cellular protein PACT mRNA, partial [house mouse.] |
| SEQ ID NO: 518 | 2292418 | 56850 | Poly(ADP-ribose) polymerase. [Norway rat.] |
| SEQ ID NO: 519 | 2294975 | 1663531 | Mouse HMG-box transcription factor (sox18) mRNA, complete cds. [house mouse.] |
| SEQ ID NO: 520 | 2295842 | 558040 | ADS39 [mice, DDS, androgen-dependent *Shionogi carcinoma*, mRNA [*Mus sp.* DDS androgen-dependent *Shionogi carcinoma.*] |
| SEQ ID NO: 521 | 2297284 | 1870703 | *Homo sapiens* CREB-binding protein mRNA, complete cds. [human.] |
| SEQ ID NO: 522 | 2298442 | 1930089 | Human Toll protein homolog mRNA, complete cds and LINE-1 reverse [human.] |
| SEQ ID NO: 523 | 2298780 | 2052191 | serine/threonine kinase. [Norway rat.] |
| SEQ ID NO: 524 | 2299185 | INCYTE | vacuolar H-ATPase subunit D [*Bos taurus*] |
| SEQ ID NO: 525 | 2303708 | 2143259 | *H. sapiens* mRNA for phosphoinositide 3-kinase. [human.] |
| SEQ ID NO: 526 | 2306416 | 57503 | *R. norvegicus* mRNA for putative zinc finger protein. [Norway rat.] |
| SEQ ID NO: 527 | 2307314 | 1834506 | *H. sapiens* mRNA for leucine zipper protein. [human.] |
| SEQ ID NO: 528 | 2309463 | 1620755 | zinc-finger protein Zn72D. [fruit fly.] |
| SEQ ID NO: 529 | 2309843 | 264008 | vik = variant in the kinase [mice, 29 mRNA, nt]. [*Mus sp.*] |
| SEQ ID NO: 530 | 2310743 | 2145080 | TGF-beta related neurotrophic factor receptor 2. [human.] |
| SEQ ID NO: 531 | 2311280 | 54915 | transferrin receptor. [house mouse.] |
| SEQ ID NO: 532 | 2311543 | 1834511 | serine/threonine protein kinase. [human.] |
| SEQ ID NO: 533 | 2313466 | INCYTE | SoxP1 [*Oncorhynchus mykiss*] |
| SEQ ID NO: 534 | 2314239 | 802104 | PP1M M21 subunit = protein phosphatase 1M [rat] |
| SEQ ID NO: 535 | 2314295 | 1857461 | immunoglobulin-like transcript-3. [human.] |
| SEQ ID NO: 536 | 2314392 | 1488263 | putative serine/threonine protein kinase PRK. [human.] |
| SEQ ID NO: 537 | 2314806 | 2145082 | TGF-beta related neurotrophic factor receptor 2. [house mouse.] |
| SEQ ID NO: 538 | 2316650 | 1568629 | *Mus musculus* nuclear LIM interactor (NLI) mRNA, complete cds. [house mouse.] |
| SEQ ID NO: 539 | 2320312 | 297026 | zinc finger protein. [human.] |
| SEQ ID NO: 540 | 2323363 | 339485 | transferrin precursor (AA at 8) [human.] |
| SEQ ID NO: 541 | 2328550 | 193572 | *Mus musculus* guanine nucleotide dissociation stimulator for a [*Mus musculus* (library: of D. Schatz |

TABLE 1-continued

| | | | |
|---|---|---|---|
| SEQ ID NO: 542 | 233623 | 184108 | and M. Oettinger) cDNA to mRNA.] Human Kruppel related gene, exon X, clone pHKR1RS. [Human DNA, clone pHKR1RS.] |
| SEQ ID NO: 543 | 2342912 | 349074 | *Rattus norvegicus* vesicla-associate calmodulin-binding protein [*Rattus norvegicus* (rat).] |
| SEQ ID NO: 544 | 2344002 | 295631 | RNA-binding protein. [baker's yeast.] |
| SEQ ID NO: 545 | 2345776 | 434018 | Yes-associated protein (65 kDa). [chicken.] |
| SEQ ID NO: 546 | 2346805 | 854536 | RPD3 gene [*Saccharomyces cerevisiae*] |
| SEQ ID NO: 547 | 2348269 | 1438876 | *Mus musculus* zinc finger protein (ZPR1) mRNA, complete cds. [house mouse.] |
| SEQ ID NO: 548 | 2348529 | 431416 | TYNWKGLLFVT [house mouse.] |
| SEQ ID NO: 549 | 2348983 | 538153 | p115. [Norway rat.] |
| SEQ ID NO: 550 | 2349726 | 685170 | adherin [*Drosophila melanogaster*] |
| SEQ ID NO: 551 | 235386 | 206534 | Sprague-Dawley (clone LRB13) RAB14 mRNA, complete cds. [*Rattus norvegicus* (strain Sprague-Dawley) (library: LAMBDA ZAPII)] |
| SEQ ID NO: 552 | 2359101 | 1066165 | coat protein gamma-cop. [*aurochs*.] |
| SEQ ID NO: 553 | 2359895 | 984114 | ribosome receptor [*Canis familiaris*] |
| SEQ ID NO: 554 | 2361065 | 2154754 | *Homo sapiens* mRNA for fructose-1,6-bisphosphatase. [human.] |
| SEQ ID NO: 555 | 2361591 | 602438 | phosphoprotein. [cow.] |
| SEQ ID NO: 556 | 2361640 | 1574998 | canalicular multispecific organic anion transporter. [human.] |
| SEQ ID NO: 557 | 2362476 | 2116688 | deltaEF1. [chicken.] |
| SEQ ID NO: 558 | 2363031 | 3028 | mitochondrial outer membrane 72K protein. [*Neurospora crassa*.] |
| SEQ ID NO: 559 | 2364091 | 24763 | alpha-2 macroglobulin receptor. [human.] |
| SEQ ID NO: 560 | 2365149 | 1161342 | *Mus musculus* interleukin 17 receptor mRNA, complete cds. [house mouse.] |
| SEQ ID NO: 561 | 2365675 | 1835659 | multidrug resistance-associated protein. [human.] |
| SEQ ID NO: 562 | 2369983 | 407991 | Mouse RNA helicase and RNA-dependent ATPase from the DEAD box [*Mus musculus* cDNA to mRNA.] |
| SEQ ID NO: 563 | 2370163 | 439260 | T26G10.1. [*Caenorhabditis elegans*.] |
| SEQ ID NO: 564 | 2371406 | 1184157 | Max-interacting transcriptional repressor. [house mouse.] |
| SEQ ID NO: 565 | 2372591 | 1546778 | *Mus musculus* p53-associated cellular protein PACT mRNA, partial [house mouse.] |
| SEQ ID NO: 566 | 2373667 | 1199603 | Human zinc finger protein C2H2-25 mRNA, complete cds. [human.] |
| SEQ ID NO: 567 | 2374748 | 455015 | DNA-binding protein. [house mouse.] |
| SEQ ID NO: 568 | 2375244 | 1151179 | *Mus musculus* frizzled-3 protein mRNA, complete cds. [house mouse.] |
| SEQ ID NO: 569 | 2375549 | 1236943 | RIP protein kinase. [human.] |
| SEQ ID NO: 570 | 2378367 | 862386 | purine specific Na+ nucleoside cotransporter [*Rattus norvegicus*] |
| SEQ ID NO: 571 | 2378372 | 57501 | unidentified ORF (60 AA). [Norway rat.] |
| SEQ ID NO: 572 | 2380464 | 1448983 | chromodomain-helicase-DNA-binding protein. [fruit fly.] |
| SEQ ID NO: 573 | 2394910 | 1293574 | transcriptional repressor protein. [fruit fly.] |
| SEQ ID NO: 574 | 2395359 | 1033033 | ribosomal S6 kinase. [human.] |
| SEQ ID NO: 575 | 2395967 | 340188 | H+ -ATPase C subunit. [human.] |
| SEQ ID NO: 576 | 2396336 | 165003 | heme-regulated eIF-2a kinase. [European rabbit.] |
| SEQ ID NO: 577 | 2414332 | 533711 | rabphilin-3A. [Norway rat.] |
| SEQ ID NO: 578 | 2415521 | 406586 | *M. musculus* NKx-5.1 mRNA. [house mouse.] |
| SEQ ID NO: 579 | 2415970 | 2145059 | *Homo sapiens* TTF-I interacting peptide 20 mRNA, partial cds. [human.] |
| SEQ ID NO: 580 | 2417796 | 407488 | unknown. [baker's yeast.] |
| SEQ ID NO: 581 | 241996 | 200999 | *Mus musculus* (clone 2) serum inducible kinase (SNK) mRNA, mRNA [*Mus musculus* cDNA to mRNA.] |
| SEQ ID NO: 582 | 2444978 | 312701 | *R. norvegicus* mRNA for TRAP-complex gamma subunit. [Norway rat.] |
| SEQ ID NO: 583 | 2444995 | 972933 | DEC205 [*Mus musculus*] |
| SEQ ID NO: 584 | 2445310 | 1016012 | neural cell adhesion protein BIG-2 precursor. [Norway rat.] |
| SEQ ID NO: 585 | 2445356 | 1256606 | EI24. [house mouse.] |
| SEQ ID NO: 586 | 2446605 | 6715 | Zn-binding protein [*Pleurodeles waltl*] |
| SEQ ID NO: 587 | 2446779 | 516726 | MafG, a bZip nuclear protein structurally related to maf oncoegene [chicken.] |
| SEQ ID NO: 588 | 2447124 | 1293574 | transcriptional repressor protein. [fruit fly.] |
| SEQ ID NO: 589 | 2447742 | 913346 | VAV2 = VAV oncogene homolog |

TABLE 1-continued

| | | | |
|---|---|---|---|
| | | | [*Homo sapiens*] |
| SEQ ID NO: 590 | 2450425 | 1518608 | *Rattus norvegicus* FGF receptor activating protein FRAG1 (FRAG1) [Norway rat.] |
| SEQ ID NO: 591 | 2451140 | 642620 | mSin3B gene product [*Mus musculus*] |
| SEQ ID NO: 592 | 2453340 | 1321818 | RING zinc finger protein. [chicken.] |
| SEQ ID NO: 593 | 2454062 | 22380 | CAAT-box DNA binding protein subunit B (NF-YB). [maize.] |
| SEQ ID NO: 594 | 2455270 | 516012 | PINCH protein. [human.] |
| SEQ ID NO: 595 | 2458266 | 1911185 | HNF-3/fork-head homolog-3. [human.] |
| SEQ ID NO: 596 | 2458342 | 170991 | ADA2. [baker's yeast.] |
| SEQ ID NO: 597 | 2470285 | 1066833 | follitropin receptor. [pig.] |
| SEQ ID NO: 598 | 2471894 | 726283 | zinc-finger protein [*Mus musculus*] |
| SEQ ID NO: 599 | 2472278 | 404781 | Rat proto-oncogene (Ets-1) mRNA, complete cds. [*Rattus norvegicus* cDNA to mRNA.] |
| SEQ ID NO: 600 | 2472462 | 206885 | *Rattus rattus* sec61 homologue mRNA, complete cds. [*Rattus rattus* liver cDNA to mRNA.] |
| SEQ ID NO: 601 | 2472878 | 1491718 | hTAFII100. [human.] |
| SEQ ID NO: 602 | 2473612 | 450532 | Sodium-Phosphate Transport System 1. [human.] |
| SEQ ID NO: 603 | 2475604 | 1814273 | Human apobec-1 binding protein 1 mRNA, complete cds. [human.] |
| SEQ ID NO: 604 | 2475740 | 399711 | G-protein coupled receptor type B, GCR type B {clone PPR1} [cattle, [cattle tongue taste papillae.] |
| SEQ ID NO: 605 | 2480469 | 561722 | monocarboxylate transporter 1. [human.] |
| SEQ ID NO: 606 | 2482853 | 704347 | paxillin [*Homo sapiens*] |
| SEQ ID NO: 607 | 2483647 | 1136637 | leucine-zipper protein. [chicken.] |
| SEQ ID NO: 608 | 2502254 | 49942 | AM2 receptor. [house mouse.] |
| SEQ ID NO: 609 | 2504131 | 600885 | *Mus musculus* signal recognition particle receptor beta subunit [mouse.] |
| SEQ ID NO: 610 | 2506506 | 1537069 | *Rattus norvegicus* nucleoporin p54 mRNA, complete cds. [Norway rat.] |
| SEQ ID NO: 611 | 2506976 | 300416 | myasthenic syndrome antigen B [human, fetal brain, 34 mRNA, nt]. [human fetal brain.] |
| SEQ ID NO: 612 | 2507750 | 1277083 | Human histone deacetylase HD1 mRNA, complete cds. [human.] |
| SEQ ID NO: 613 | 2507903 | 307329 | protocadherin 43. [human.] |
| SEQ ID NO: 614 | 2508812 | 971464 | K-Cl cotransporter [*Homo sapiens*] |
| SEQ ID NO: 615 | 2509024 | 807817 | human putative RNA helicase HRH1 [*Homo sapiens*] |
| SEQ ID NO: 616 | 2509610 | 602434 | GABA/noradrenaline transporter. [human.] |
| SEQ ID NO: 617 | 2510184 | 2150135 | *Mus musculus* mitotic checkpoint protein kinase (Bub1) mRNA, [house mouse.] |
| SEQ ID NO: 618 | 2511250 | 1174018 | RU49. [house mouse.] |
| SEQ ID NO: 619 | 251188 | 538151 | p115. [cow.] |
| SEQ ID NO: 620 | 2512273 | 1000125 | PRK2. [human.] |
| SEQ ID NO: 621 | 2515448 | 505088 | hSNF2b. [human.] |
| SEQ ID NO: 622 | 2517151 | INCYTE | translocase [*Bos taurus*] |
| SEQ ID NO: 623 | 2517343 | 164271 | alpha 1B-glycoprotein. [North American opossum.] |
| SEQ ID NO: 624 | 2527954 | 311339 | unknown. [thale cress.] |
| SEQ ID NO: 625 | 2528163 | 531750 | probable mitochondrial protein. [baker's yeast.] |
| SEQ ID NO: 626 | 2529044 | 35219 | Human mRNA for p68 protein. [human.] |
| SEQ ID NO: 627 | 2529619 | 2121229 | *Homo sapiens* BAC129, complete sequence. [human.] |
| SEQ ID NO: 628 | 2530840 | 1914258 | F45G2.c. [*Caenorhabditis elegans.*] |
| SEQ ID NO: 629 | 2531047 | 1151253 | *Mus musculus* putative transmembrane receptor (frizzled 4) mRNA, [house mouse.] |
| SEQ ID NO: 630 | 2538191 | 250811 | putative ATP-dependent RNA helicase = Dbp73D [Drosophila, Peptide, [Drosophila.] |
| SEQ ID NO: 631 | 2544879 | 607132 | AEBP1 gene product [house mouse] |
| SEQ ID NO: 632 | 2545475 | 191143 | Hamster mevalonate transporter mRNA, complete cds. [*Cricetulus sp.* cDNA to mRNA.] |
| SEQ ID NO: 633 | 2547002 | 399711 | G-protein coupled receptor type B, GCR type B {clone PPR1} [cattle, [cattle tongue taste papillae.] |
| SEQ ID NO: 634 | 2549980 | 289622 | homology with ATP-dependent RNA helicase; putative. [*Caenorhabditis elegans.*] |
| SEQ ID NO: 635 | 2552764 | 2116551 | Rat mRNA for cationic amino acid transporter 3, complete cds. [*Rattus norvegicus* brain cDNA to mRNA.] |
| SEQ ID NO: 636 | 2552810 | 642617 | mSin3A9 gene product [*Mus musculus*] |

TABLE 1-continued

| | | | |
|---|---|---|---|
| SEQ ID NO: 637 | 2553280 | 767871 | P2Y purinoceptor [*Mus musculus*] |
| SEQ ID NO: 638 | 2553318 | 541665 | dTAF 1 II. [fruit fly.] |
| SEQ ID NO: 639 | 2554189 | 286204 | ATP synthase subunit d precursor. [*Rattus sp.*] |
| SEQ ID NO: 640 | 2554479 | 666103 | pre-mRNA splicing factor RNA helicase PR [*C. elegans*] |
| SEQ ID NO: 641 | 2554757 | 1293686 | transcription factor C1 (HCF) [house mouse.] |
| SEQ ID NO: 642 | 2586664 | 1246760 | *H. sapiens* mRNA for SIX1 protein. [human.] |
| SEQ ID NO: 643 | 2586678 | 1107696 | Mi-2 protein. [human.] |
| SEQ ID NO: 644 | 2586966 | 1107695 | *H. sapiens* mRNA 2 forkD Mi-2 protein. [human.] |
| SEQ ID NO: 645 | 2594056 | 1806048 | nuclear DNA helicase II. [human.] |
| SEQ ID NO: 646 | 2596614 | 1107696 | Mi-2 protein. [human.] |
| SEQ ID NO: 647 | 2597007 | 304346 | coded for by *C. elegans* cDNAs GenBank: M88869 and T01933; putative. [*Caenorhabditis elegans.*] |
| SEQ ID NO: 648 | 2599320 | 1655970 | *Mus musculus* LIM domain binding protein 1 (Ldb1) mRNA, complete [house mouse.] |
| SEQ ID NO: 649 | 259999 | 2125814 | serine/threonine protein kinase. [human.] |
| SEQ ID NO: 650 | 2600088 | 2052521 | Ca2+ ATPase of fast-twitch skeletal muscle sacroplasmic reticulum, [human.] |
| SEQ ID NO: 651 | 2601127 | 186624 | Human c-jun proto oncogene (JUN), complete cds, clone hCJ-1. [*Homo sapiens* DNA.] |
| SEQ ID NO: 652 | 260827 | 235649 | tumor necrosis factor receptor, TNF receptor = 75-kda [human, human.] |
| SEQ ID NO: 653 | 2608345 | 204637 | homeobox protein. [Norway rat.] |
| SEQ ID NO: 654 | 261759 | 6715 | F54G8.4 [*C. elegans*] |
| SEQ ID NO: 655 | 2621425 | 1117797 | calcitonin receptor isoform. [human.] |
| SEQ ID NO: 656 | 262183 | 498726 | *H. sapiens* HZF4 mRNA for zinc finger protein. [human.] |
| SEQ ID NO: 657 | 262194 | 291867 | Human vacuolar ATPase (isoform VA68) mRNA, complete cds. [*Homo sapiens* cDNA to mRNA; and *Homo sapiens* DNA.] |
| SEQ ID NO: 658 | 2622817 | 1172087 | squamous cell carcinoma antigen. [human.] |
| SEQ ID NO: 659 | 2623304 | 2121229 | *Homo sapiens* BAC129, complete sequence. [human.] |
| SEQ ID NO: 660 | 2626405 | 439260 | T26G10.1. [*Caenorhabditis elegans.*] |
| SEQ ID NO: 661 | 2626716 | 1399804 | Human Bcl2, p53 binding protein Bbp/53BP2 (BBP/53BP2) mRNA, [human.] |
| SEQ ID NO: 662 | 2626996 | 1504027 | Human mRNA for KIAA0224 gene, complete cds. [*Homo sapiens* male bone marrow myeloblast cell_line: KG-1 cDNA to] |
| SEQ ID NO: 663 | 2630126 | 1935043 | metabotropic glutamate receptor 8. [human.] |
| SEQ ID NO: 664 | 2633233 | 1373425 | bumetanide-sensitive Na-K-2Cl cotransporter. [human.] |
| SEQ ID NO: 665 | 2634993 | 2052512 | Human Ca2+ ATPase of fast-twitch skeletal muscle sarcoplasmic [human.] |
| SEQ ID NO: 666 | 2636546 | 2052519 | Human Ca2+ ATPase of fast-twitch skeletal muscle sarcoplasmic [human.] |
| SEQ ID NO: 667 | 2638437 | 2052518 | Human Ca2+ ATPase of fast-twitch skeletal muscle sarcoplasmic [human.] |
| SEQ ID NO: 668 | 264357 | 406057 | *Mus musculus* MAST205 protein kinase mRNA, complete cds. [house mouse.] |
| SEQ ID NO: 669 | 2645654 | 292496 | transcription activator. [human.] |
| SEQ ID NO: 670 | 2645761 | 506502 | NK10 gene product. [house mouse.] |
| SEQ ID NO: 671 | 264733 | 1373393 | Human zinc finger protein (LD5-1) mRNA, complete cds. [human.] |
| SEQ ID NO: 672 | 264823 | 183181 | Human guanine nucleotide-binding regulatory protein (G) [Human fetal liver mononuclear cell, and peripheral blood] |
| SEQ ID NO: 673 | 2657496 | 1763263 | secretory leukocyte protease inhibitor. [house mouse.] |
| SEQ ID NO: 674 | 2658454 | 1507819 | *H. sapiens* mRNA for canalicular multidrug resistance protein. [human.] |
| SEQ ID NO: 675 | 265958 | 482944 | *Rattus norvegicus* glutamate receptor (GluR-B) mRNA, complete cds. [rat.] |
| SEQ ID NO: 676 | 266285 | 293346 | *Mus musculus* putative transforming growth factor-beta (GDF-3) mRNA, [*Mus musculus* (strain CD-1) adult bone marrow cDNA to mRNA.] |
| SEQ ID NO: 677 | 266495 | 443688 | Rat eukaryotic hemin-sensitive initiation factor 2a kinase (eIF-2a) [*Rattus norvegicus* (strain Sprague-Dawley) cDNA to mRNA.] |
| SEQ ID NO: 678 | 268619 | 1750276 | pim-2 protooncogene homolog pim-2h. [human.] |
| SEQ ID NO: 679 | 269479 | 457680 | cyclin B2. [golden hamster.] |
| SEQ ID NO: 680 | 269891 | 841317 | mutant sterol regulatory element binding protein [*Cricetulus griseus*] |
| SEQ ID NO: 681 | 270379 | 1220475 | casein kinase-II beta. [European rabbit.] |

TABLE 1-continued

| | | | |
|---|---|---|---|
| SEQ ID NO: 682 | 270565 | 1321643 | Human mRNA for apolipoprotein E receptor 2, complete cds. [*Homo sapiens* placenta RNA, clone: pNR1.] |
| SEQ ID NO: 683 | 2725053 | 4522 | spb4 protein product (AA 1-606) [baker's yeast.] |
| SEQ ID NO: 684 | 2726431 | 1049300 | Human KRAB zinc finger protein (ZNF177) mRNA, complete cds. [human.] |
| SEQ ID NO: 685 | 2729155 | 862411 | cbl-b truncated form 2 [*Homo sapiens*] |
| SEQ ID NO: 686 | 2729621 | 206885 | *Rattus rattus* sec61 homologue mRNA, complete cds. [*Rattus rattus* liver cDNA to mRNA.] |
| SEQ ID NO: 687 | 273061 | 1732123 | monocyte chemoattractant protein-4 precursor. [human.] |
| SEQ ID NO: 688 | 2730802 | 186773 | Human Kruppel related zinc finger protein (HTF10) mRNA, complete [*Homo sapiens* (tissue library: Lambda gt10) teratocarcinoma cDNA to] |
| SEQ ID NO: 689 | 2732557 | 1122433 | polypyrimidine tract-binding protein. [pig.] |
| SEQ ID NO: 690 | 2733660 | 1518135 | multidrug resistance related protein 1. [*Caenorhabditis elegans.*] |
| SEQ ID NO: 691 | 2733865 | 38031 | Human ZNF43 mRNA. [human.] |
| SEQ ID NO: 692 | 2735796 | 1488275 | zinc finger protein basonuclin. [human.] |
| SEQ ID NO: 693 | 2738710 | 220477 | ORF for Mel-18. [house mouse.] |
| SEQ ID NO: 694 | 2739189 | 50866 | enhancer-trap-locus-1. [house mouse.] |
| SEQ ID NO: 695 | 2739264 | 1537069 | *Rattus norvegicus* nucleoporin p54 mRNA, complete cds. [Norway rat.] |
| SEQ ID NO: 696 | 276815 | 1923265 | Human AP-3 complex delta subunit mRNA, complete cds. [human.] |
| SEQ ID NO: 697 | 283526 | 2052369 | Human Chromosome 11 pac pDJ1173a5, complete sequence. [human.] |
| SEQ ID NO: 698 | 288246 | 211916 | <no link>. [chicken.] |
| SEQ ID NO: 699 | 292734 | 1907316 | Human immunoglobulin-like transcript 1 mRNA, complete cds. [human.] |
| SEQ ID NO: 700 | 305077 | 1122887 | Human DNA sequence from cosmid L141A8, Huntington's Disease Region, [human.] |
| SEQ ID NO: 701 | 305403 | 841317 | mutant sterol regulatory element binding protein [*Cricetulus griseus*] |
| SEQ ID NO: 702 | 306020 | 1220313 | interleukin-1 receptor-associated kinase. [human.] |
| SEQ ID NO: 703 | 307624 | 1857943 | Human serine kinase SRPK2 mRNA, complete cds. [human.] |
| SEQ ID NO: 704 | 309628 | 1890117 | *Homo sapiens* casein kinase I gamma 2 mRNA, complete cds. [human.] |
| SEQ ID NO: 705 | 312069 | 488556 | Human zinc finger protein ZNF137 mRNA, complete cds. [human.] |
| SEQ ID NO: 706 | 313542 | 1177700 | MAPKAPK-4. [*Hemicentrotus pulcherrimus.*] |
| SEQ ID NO: 707 | 320054 | 1750275 | Human pim-2 protooncogene homolog pim-2h mRNA, complete cds. [human.] |
| SEQ ID NO: 708 | 320206 | 49442 | Guinea pig mRNA for platelet activating factor (PAF) receptor. [*Cavia cutleri.*] |
| SEQ ID NO: 709 | 322206 | 293729 | *Mus musculus* MEK kinase mRNA, complete cds. [*Mus musculus* (strain BALB/c, sub_species domesticus) (library:] |
| SEQ ID NO: 710 | 334703 | 164241 | serpin. [domestic horse.] |
| SEQ ID NO: 711 | 334957 | 186567 | Human transcription factor ISGF-3 mRNA sequence. [*Homo sapiens* female cultured cells cDNA to mRNA.] |
| SEQ ID NO: 712 | 339963 | 632964 | clk1; putative [*Homo sapiens*] |
| SEQ ID NO: 713 | 342106 | 2065529 | bikunin. [human.] |
| SEQ ID NO: 714 | 342411 | 495198 | thrombin receptor. [African clawed frog.] |
| SEQ ID NO: 715 | 343904 | 183298 | GLUT5 protein. [human.] |
| SEQ ID NO: 716 | 345221 | 547029 | T cell receptor-associated protein tyrosine kinase ZAP-70 (kinase [human severe combined immunodeficiency patient.] |
| SEQ ID NO: 717 | 346874 | 285995 | KIAA0001. [human.] |
| SEQ ID NO: 718 | 348485 | 54197 | *M. musculus* mRNA for somatostatin receptor. [house mouse.] |
| SEQ ID NO: 719 | 358600 | 1711202 | *Mus musculus* Slug zinc finger protein (Slugh) mRNA, complete cds. [house mouse.] |
| SEQ ID NO: 720 | 364214 | 31218 | KDEL receptor. [human.] |
| SEQ ID NO: 721 | 364680 | 516780 | Mouse mRNA for G protein-coupled receptor, complete cds. [*Mus musculus* (strain BALB/c) adult brain (library: lambda gt10] |
| SEQ ID NO: 722 | 364702 | 902330 | putative olfactory receptor [*Homo sapiens*] |
| SEQ ID NO: 723 | 365524 | 758366 | 5'-AMP-activated protein kinase alpha-1 [*Homo sapiens*] |
| SEQ ID NO: 724 | 365909 | 1000126 | Human lipid-activated protein kinase PRK1 mRNA, complete cds. [human.] |
| SEQ ID NO: 725 | 370076 | 1575615 | Human ZFP-36 mRNA for a zinc finger protein. [human.] |
| SEQ ID NO: 727 | 373116 | 1945270 | *H. sapiens* mRNA for protein phosphatase 6. [human.] |

TABLE 1-continued

| SEQ ID NO: 728 | 375659 | 55505 | Murine trkB mRNA for tyrosine protein kinase receptor. [*Mus sp.*] |
| SEQ ID NO: 729 | 377292 | 1049101 | atrophin-1 [*Rattus norvegicus*] |
| SEQ ID NO: 730 | 381698 | 1463028 | voltage dependent anion channel 3. [house mouse.] |
| SEQ ID NO: 731 | 390371 | 1052736 | *H. sapiens* mRNA for protein kinase, PKX1. [human.] |
| SEQ ID NO: 732 | 391609 | 930123 | zinc finger protein [*Homo sapiens*] |
| SEQ ID NO: 733 | 393531 | 1310668 | *H. sapiens* HOK-2 gene, exon 2. [human.] |
| SEQ ID NO: 734 | 393590 | 498727 | zinc finger protein. [human.] |
| SEQ ID NO: 735 | 394776 | 200407 | pMLZ-4. [house mouse.] |
| SEQ ID NO: 736 | 394838 | 1020144 | Human DNA binding protein (HPF2) mRNA, complete cds. [human.] |
| SEQ ID NO: 737 | 395476 | 57503 | *R. norvegicus* mRNA for putative zinc finger protein. [Norway rat.] |
| SEQ ID NO: 738 | 398934 | 554203 | zinc finger protein mfg1 mRNA (put.); putative. [house mouse.] |
| SEQ ID NO: 739 | 401269 | 190219 | Human protein phosphatase 1 2A kDa regulatory subunit mRNA, [*Homo sapiens* (library: lambda ZAP; Stratagene/lambda gt10;] |
| SEQ ID NO: 740 | 401429 | 1695926 | Human apoptosis-mediating receptor TRAMP ex mRNA, alternatively [human.] |
| SEQ ID NO: 741 | 401777 | 1399508 | protein kinase MUK2. [Norway rat.] |
| SEQ ID NO: 742 | 402573 | INCYTE | asialoglycoprotein receptor [*Rattus norvegicus*] |
| SEQ ID NO: 743 | 402727 | 395086 | *H. sapiens* mRNA for transcription factor BTF 3. [human.] |
| SEQ ID NO: 744 | 403002 | 157796 | finger protein. [fruit fly.] |
| SEQ ID NO: 745 | 407546 | 944911 | inositol polyphosphate 4-phosphatase [*Homo sapiens*] |
| SEQ ID NO: 746 | 413718 | 517352 | zinc-finger protein (ZNFpT3). [human.] |
| SEQ ID NO: 747 | 415685 | 303699 | Mouse mRNA for prostaglandin E receptor EP2 subtype, complete cds. [*Mus musculus* (strain BDF1) mast cell, mastocytoma P-815 ZAPII] |
| SEQ ID NO: 748 | 415908 | 456189 | *H. sapiens* F11 mRNA. [human.] |
| SEQ ID NO: 749 | 415935 | 31665 | Human hGATA3 mRNA for trans-acting T-cell specific transcription [human.] |
| SEQ ID NO: 750 | 417398 | 304384 | G protein-coupled receptor. [chicken.] |
| SEQ ID NO: 751 | 426033 | 387675 | protocadherin 42. [human.] |
| SEQ ID NO: 752 | 427133 | 1699001 | zinc finger 1 protein. [human.] |
| SEQ ID NO: 753 | 428421 | 1907316 | Human immunoglobulin-like transcript 1 mRNA, complete cds. [human.] |
| SEQ ID NO: 754 | 435043 | 1679667 | Human mitogen-activated kinase kinase kinase 5 (MAPKKK5) mRNA, [human.] |
| SEQ ID NO: 755 | 440242 | 309209 | early B-cell factor. [house mouse.] |
| SEQ ID NO: 756 | 442279 | 2104521 | C-C chemokine receptor 6. (CCR6) [human.] |
| SEQ ID NO: 757 | 445186 | 1840405 | membrane guanylyl cyclase OLGC5. [Japanese medaka.] |
| SEQ ID NO: 758 | 446750 | 200999 | *Mus musculus* (clone 2) serum inducible kinase (SNK) mRNA, mRNA [*Mus musculus* cDNA to mRNA.] |
| SEQ ID NO: 759 | 448504 | 405737 | protein-serine/threonine kinase. [human.] |
| SEQ ID NO: 760 | 449555 | 431328 | transcription factor. [human.] |
| SEQ ID NO: 761 | 451192 | 32072 | Human HF.12 gene mRNA. [human.] |
| SEQ ID NO: 762 | 451538 | 1857331 | KHS1. [human.] |
| SEQ ID NO: 763 | 453980 | 1907325 | immunoglobulin-like transcript 2. [human.] |
| SEQ ID NO: 764 | 455539 | 307184 | *Homo sapiens* ERK activator kinase (MEK2) mRNA. [*Homo sapiens* cDNA to mRNA.] |
| SEQ ID NO: 765 | 456122 | 347905 | Human zinc finger protein (ZNF141) mRNA, complete cds. [*Homo sapiens* insulinoma cDNA to mRNA.] |
| SEQ ID NO: 766 | 464199 | 406057 | *Mus musculus* MAST205 protein kinase mRNA, complete cds. [house mouse.] |
| SEQ ID NO: 767 | 472480 | 1066795 | *Homo sapiens* (clone exon trap B29) 16 chromosome.3 gene, exon. [*Homo sapiens* (clone: exon trap B29) DNA.] |
| SEQ ID NO: 768 | 472981 | 458710 | Stat1. [house mouse.] |
| SEQ ID NO: 769 | 474377 | 179579 | Human beta-thromboglobulin-like protein mRNA, complete cds. [Human peripheral blood leucocyte, cDNA to mRNA, clone 3-10C.] |
| SEQ ID NO: 770 | 475180 | 1871197 | Human 16 chromosome BAC clone CIT987SK-962B4 complete sequence. [human.] |
| SEQ ID NO: 771 | 476625 | 200522 | Mouse protein tyrosine phosphatase (70zpep) mRNA, complete cds. [*Mus musculus* cDNA to mRNA.] |
| SEQ ID NO: 772 | 477245 | 1834511 | serine/threonine protein kinase. [human.] |
| SEQ ID NO: 773 | 477518 | 1817583 | *H. sapiens* mRNA for adaptor protein p150. [human.] |
| SEQ ID NO: 774 | 478682 | 297025 | *H. sapiens* mRNA for zinc finger protein. [human.] |
| SEQ ID NO: 775 | 478861 | 1262811 | CC-CKR5. [human.] |
| SEQ ID NO: 776 | 480457 | 1109782 | protein-tyrosine phosphatase. [human.] |
| SEQ ID NO: 777 | 480959 | 33949 | *H. sapiens* mRNA for integrin, alpha subunit. [human.] |
| SEQ ID NO: 778 | 482881 | 995918 | G protein gamma-10 subunit [*Homo sapiens*] |

TABLE 1-continued

| | | | |
|---|---|---|---|
| SEQ ID NO: 779 | 485081 | 205039 | *Rattus norvegicus* K+ channel mRNA, sequence. [*Rattus norvegicus* adult brain cDNA to mRNA.] |
| SEQ ID NO: 780 | 485164 | 298096 | *H. sapiens* subunit of coatomer complex. [human.] |
| SEQ ID NO: 781 | 485985 | 1669685 | protein kinase. [human.] |
| SEQ ID NO: 782 | 486596 | 1032629 | *H. sapiens* CpG island DNA genomic Mse1 fragment, 27 clone, reverse [human.] |
| SEQ ID NO: 783 | 487363 | 406058 | protein kinase. [house mouse.] |
| SEQ ID NO: 784 | 487794 | 1527 | calcium channel BI-2. [European rabbit.] |
| SEQ ID NO: 785 | 488190 | 2073564 | eukaryotic initiation factor eIF-2 alpha kinase; DGCN2. [fruit fly.] |
| SEQ ID NO: 786 | 488722 | 1304388 | phosphotyrosyl phosphatase [*Oryctolagus cuniculus*] |
| SEQ ID NO: 787 | 490234 | 1171564 | metabotropic glutamate receptor type 3 (mGluR3). [human.] |
| SEQ ID NO: 788 | 490256 | 296127 | pAP8 product. [common tobacco.] |
| SEQ ID NO: 789 | 490609 | 1103425 | *H. sapiens* DMAHP gene. [human.] |
| SEQ ID NO: 790 | 491152 | 203467 | Rat voltage-gated K+ channel protein (RK5) mRNA, complete cds. [Rat (Sprague-Dawley) adult heart, cDNA to mRNA.] |
| SEQ ID NO: 791 | 491271 | 498731 | zinc finger protein. [human.] |
| SEQ ID NO: 792 | 491446 | 1923266 | AP-3 complex delta subunit. [human.] |
| SEQ ID NO: 793 | 492611 | 1304599 | ZNF127-Xp. [human.] |
| SEQ ID NO: 794 | 493684 | 1354136 | *Rattus norvegicus* MAP kinase kinase kinase 1 (MEKK1) mRNA, complete [Norway rat.] |
| SEQ ID NO: 795 | 506361 | 1923266 | AP-3 complex delta subunit. [human.] |
| SEQ ID NO: 796 | 507537 | 172168 | phosphatase. [baker's yeast.] |
| SEQ ID NO: 797 | 509215 | 406057 | *Mus musculus* MAST205 protein kinase mRNA, complete cds. [house mouse.] |
| SEQ ID NO: 798 | 511091 | 498726 | *H. sapiens* HZF4 mRNA for zinc finger protein. [human.] |
| SEQ ID NO: 799 | 511655 | 1049020 | Kruppel-like factor LKLF. [house mouse.] |
| SEQ ID NO: 800 | 513418 | 1902982 | lectin-like oxidized LDL receptor. [*Bos taurus.*] |
| SEQ ID NO: 801 | 514710 | 1345402 | interleukin 3receptor alpha subunit. [human.] |
| SEQ ID NO: 802 | 515253 | 1228944 | protein tyrosine phosphatase epsilon M. [Norway rat.] |
| SEQ ID NO: 803 | 515399 | 414113 | (MHC) class II transactivator. [human.] |
| SEQ ID NO: 804 | 515847 | 1902984 | lectin-like oxidized LDL receptor. [human.] |
| SEQ ID NO: 805 | 516219 | 1245048 | serine/threonine kinase. [*Caenorhabditis elegans.*] |
| SEQ ID NO: 806 | 522433 | 1813326 | *Homo sapiens* mRNA for TGF-beta superfamily protein, complete cds. [*Homo sapiens* Fibrosarcoma cell_line: HT-1080 cDNA to mRNA,] |
| SEQ ID NO: 807 | 523374 | 1145292 | Human IAP homolog B (MIHB) mRNA, complete cds. [human.] |
| SEQ ID NO: 808 | 529450 | 1857943 | Human serine kinase SRPK2 mRNA, complete cds. [human.] |
| SEQ ID NO: 809 | 531037 | 337490 | Human rac protein kinase beta mRNA, complete cds. [*Homo sapiens* (library: MCF-7 lambda gt10; WI38 lambda gt10) cDNA to] |
| SEQ ID NO: 810 | 531038 | 517446 | vacuolar H-ATPase subunit D. [gaur.] |
| SEQ ID NO: 811 | 531418 | 443688 | Rat eukaryotic hemin-sensitive initiation factor 2a kinase (eIF-2a) [*Rattus norvegicus* (strain Sprague-Dawley) cDNA to mRNA.] |
| SEQ ID NO: 812 | 534110 | 507415 | brain specific Na+-dependent inorganic phosphate cotransporter. [Norway rat.] |
| SEQ ID NO: 813 | 534380 | 206530 | Sprague-Dawley (clone LRB6) RAB12 mRNA, 3'end. [*Rattus norvegicus* (strain Sprague-Dawley) (library: LAMBDA ZAPII)] |
| SEQ ID NO: 814 | 535129 | 516383 | transcription factor. [human.] |
| SEQ ID NO: 815 | 535503 | 438373 | protein kinase C mu. [human.] |
| SEQ ID NO: 816 | 537221 | 288424 | *H. sapiens* ZNF37A mRNA for zinc finger protein. [human.] |
| SEQ ID NO: 817 | 539564 | 429187 | *Mus musculus* zinc finger protein (Sna) mRNA, complete cds. [*Mus musculus* embryo cDNA to mRNA.] |
| SEQ ID NO: 818 | 539754 | 1049301 | KRAB zinc finger protein; Method: conceptual translation supplied [human.] |
| SEQ ID NO: 819 | 543748 | 200406 | *Mus musculus* protein encoding twelve zinc finger proteins (pMLZ-4) [*Mus musculus* (library: Lambda ZAP) newborn cDNA to mRNA.] |
| SEQ ID NO: 820 | 543989 | 488550 | Human zinc finger protein ZNF132 mRNA, complete cds. [human.] |
| SEQ ID NO: 821 | 547319 | 183410 | Human brain guanine nucleotide-binding protein alpha-i subunit [Human, cDNA to mRNA, clones BG-4 and BG21-2.] |
| SEQ ID NO: 822 | 548019 | 190734 | Human protein-tyrosine kinase (JAK1) mRNA, complete cds. [*Homo sapiens* cDNA to mRNA.] |
| SEQ ID NO: 823 | 548607 | 250743 | inositol monophosphatase, myo-inositol monophosphatase {EC [human hippocampus.] |
| SEQ ID NO: 824 | 548950 | 1065409 | bomapin. [human.] |
| SEQ ID NO: 825 | 552800 | 57504 | zinc finger protein. [Norway rat.] |
| SEQ ID NO: 826 | 553106 | 1171564 | metabotropic glutamate receptor type 3 (mGluR3). [human.] |
| SEQ ID NO: 827 | 553217 | 498729 | zinc finger protein. [human.] |
| SEQ ID NO: 828 | 554215 | INCYTE | fat protein [*Drosophila melanogaster*] |
| SEQ ID NO: 829 | 555188 | 1854512 | ATP receptor. [human.] |
| SEQ ID NO: 830 | 555552 | 961490 | Rat mRNA for neuronal high affinity glutamate transporter [*Rattus norvegicus*] |

TABLE 1-continued

| SEQ ID NO: | | | |
|---|---|---|---|
| SEQ ID NO: 831 | 555697 | 1781009 | P2X4 purinoceptor. [human.] |
| SEQ ID NO: 832 | 557918 | 190220 | protein phosphatase 1 2A kDa regulatory subunit. [human.] |
| SEQ ID NO: 833 | 559803 | 453376 | zinc finger protein PZF. [house mouse.] |
| SEQ ID NO: 834 | 565623 | 1905897 | *Homo sapiens* DNA from chromosome 19-cosmid f19399 (~17 kb EcoRI [*Homo sapiens* (clone_lib: LL19NC02 F2 chromosome 19-specific cosmid] |
| SEQ ID NO: 835 | 566670 | 453373 | zinc finger protein. [house mouse.] |
| SEQ ID NO: 836 | 568080 | 1769490 | Human kruppel-related zinc finger protein (ZNF184) mRNA, partial [human.] |
| SEQ ID NO: 837 | 568987 | 285995 | KIAA0001. [human.] |
| SEQ ID NO: 838 | 569038 | 286105 | zinc finger protein. [house mouse.] |
| SEQ ID NO: 839 | 569648 | 682722 | MARCO [*Mus musculus*] |
| SEQ ID NO: 840 | 581952 | 157196 | D-ets-4 DNA binding domain protein. [fruit fly.] |
| SEQ ID NO: 841 | 585906 | 431415 | Mouse (BALB/c) alpha-7 integrin mRNA, complete cds. [*Mus musculus* (mouse).] |
| SEQ ID NO: 842 | 589144 | 1848233 | DNA-binding protein CBA1. [human.] |
| SEQ ID NO: 843 | 589345 | 1773293 | tissue inhibitor of metalloproteinase 4. [human.] |
| SEQ ID NO: 844 | 589487 | 1177700 | MAPKAPK-4. [*Hemicentrotus pulcherrimus*.] |
| SEQ ID NO: 845 | 599596 | 984114 | ribosome receptor [*Canis familiaris*] |
| SEQ ID NO: 846 | 600663 | 2149792 | Roaz. [Norway rat.] |
| SEQ ID NO: 847 | 602926 | 1163141 | potassium channel alpha subunit Kv2.2. [African clawed frog.] |
| SEQ ID NO: 848 | 605666 | 205814 | olfactory protein. [Norway rat.] |
| SEQ ID NO: 849 | 607820 | 1296426 | type ii small proline rich protein [*Ovis aries*] |
| SEQ ID NO: 850 | 608819 | 1184066 | calcium-activated chloride channel. [cow.] |
| SEQ ID NO: 851 | 609792 | 2077934 | Protein Kinase. [Norway rat.] |
| SEQ ID NO: 852 | 609982 | 431415 | Mouse (BALB/c) alpha-7 integrin mRNA, complete cds. [*Mus musculus* (mouse).] |
| SEQ ID NO: 853 | 611390 | 2145062 | TTF-I interacting peptide 21; TIP21; Transcription Termination [human.] |
| SEQ ID NO: 854 | 618092 | 459748 | Sec61-complex gamma-subunit. [dog.] |
| SEQ ID NO: 855 | 619240 | 467319 | hexose carrier protein. [castor bean.] |
| SEQ ID NO: 856 | 619292 | 2104785 | 9ORF binding protein 1. [house mouse.] |
| SEQ ID NO: 857 | 621179 | 550067 | *Homo sapiens* GTP-binding protein (RAB4) mRNA, complete cds. [*Homo sapiens* (tissue library: of J. Mallet) pheochromocytoma cDNA to] |
| SEQ ID NO: 858 | 627813 | 1881554 | Human cosmid g1980a018, complete sequence. [human.] |
| SEQ ID NO: 859 | 629242 | 902886 | Ksp-cadherin [*Oryctolagus cuniculus*] |
| SEQ ID NO: 860 | 632097 | 206430 | proton pump polypeptide. [Norway rat.] |
| SEQ ID NO: 861 | 632449 | 1103873 | TDAG8. [house mouse.] |
| SEQ ID NO: 862 | 633696 | 1813646 | MEK kinase 3. [human.] |
| SEQ ID NO: 863 | 635376 | 1698720 | zinc finger protein. [human.] |
| SEQ ID NO: 864 | 637331 | 1871539 | mitogen-activated protein kinase phosphatase 4. [human.] |
| SEQ ID NO: 865 | 639017 | 1399863 | GDNF receptor alpha. [Norway rat.] |
| SEQ ID NO: 866 | 639489 | 1151256 | transmembrane receptor. [house mouse.] |
| SEQ ID NO: 867 | 639750 | 1613852 | zinc finger protein zfp2. [human.] |
| SEQ ID NO: 868 | 640759 | 1872474 | *Mus musculus* transcription factor Sox-M (sox-M) mRNA, partial cds. [house mouse.] |
| SEQ ID NO: 869 | 641384 | 807817 | Cdc28p [*Schizosaccharomyces pombe*] |
| SEQ ID NO: 870 | 662342 | 1369844 | sulfonylurea receptor. [human.] |
| SEQ ID NO: 871 | 669862 | 498721 | zinc finger protein. [human.] |
| SEQ ID NO: 872 | 670279 | 1914307 | F49C5.g. [*Caenorhabditis elegans*.] |
| SEQ ID NO: 873 | 670448 | 1613852 | zinc finger protein zfp2. [human.] |
| SEQ ID NO: 874 | 671514 | 193400 | Murine GABA-A receptor delta-subunit gene, exon 9. [Murine DNA.] |
| SEQ ID NO: 875 | 674892 | 1009708 | clathrin-associated AP-2 complex AP50 subunit. [house mouse.] |
| SEQ ID NO: 876 | 674947 | 56281 | *R. norvegicus* cDNA for glutamate receptor subunit (GluR6), kainate [Norway rat.] |
| SEQ ID NO: 877 | 675190 | 498152 | ha0946 protein is Kruppel-related. [human.] |
| SEQ ID NO: 878 | 676592 | 1203968 | *Homo sapiens* chromosome X region from filamin (FLN) gene to [human.] |
| SEQ ID NO: 879 | 677049 | 340443 | Human zinc finger protein 41 (ZNF41) gene, 3' end. [*Homo sapiens* (tissue library: Laoxnloi: 577 ATCC) adult DNA.] |
| SEQ ID NO: 880 | 678003 | 456189 | *H. sapiens* F11 mRNA. [human.] |
| SEQ ID NO: 881 | 679760 | 339714 | Human tyrosine kinase (FER) mRNA, complete cds. [Human fibroblast, cDNA to mRNA.] |
| SEQ ID NO: 882 | 680833 | 1502342 | *H. sapiens* mRNA for receptor phosphate PCP-2. [human.] |
| SEQ ID NO: 883 | 683211 | 157409 | fat protein. [fruit fly.] |
| SEQ ID NO: 884 | 684126 | 184108 | Human Kruppel related gene, exon X, clone PHKR1RS. [Human DNA, clone pHKR1RS.] |
| SEQ ID NO: 885 | 685434 | 1146129 | integrin-linked kinase. [human.] |
| SEQ ID NO: 886 | 687223 | 438372 | *H. sapiens* mRNA for protein kinase C mu. [human.] |
| SEQ ID NO: 887 | 688183 | 33985 | trypsin inhibitor. [human.] |
| SEQ ID NO: 888 | 689078 | 1155052 | anterior-restricted homeobox protein. [house mouse.] |
| SEQ ID NO: 889 | 689776 | 682722 | MARCO [*Mus musculus*]] |
| SEQ ID NO: 890 | 690231 | 182847 | G0S19-1 peptide precursor. [human.] |

TABLE 1-continued

| | | | |
|---|---|---|---|
| SEQ ID NO: 891 | 692341 | 34141 | Human Kox1 gene for zinc finger protein. [human.] |
| SEQ ID NO: 892 | 693783 | 2052369 | Human Chromosome 11 pac pDJ1173a5, complete sequence. [human.] |
| SEQ ID NO: 893 | 696484 | 34339 | LDL-receptor related precursor (AA - 19 45 to). [human.] |
| SEQ ID NO: 894 | 699542 | 187268 | Human lyn mRNA encoding a tyrosine kinase. [Human cDNA to mRNA.] |
| SEQ ID NO: 895 | 700261 | 599827 | serine/threonine protein kinase. [human.] |
| SEQ ID NO: 896 | 700322 | 200999 | *Mus musculus* (clone 2) serum inducible kinase (SNK) mRNA, mRNA [*Mus musculus* cDNA to mRNA.] |
| SEQ ID NO: 897 | 704164 | 1448983 | chromodomain-helicase-DNA-binding protein. [fruit fly.] |
| SEQ ID NO: 898 | 705322 | 1050529 | *H. sapiens* ZNF74-1 mRNA. [human.] |
| SEQ ID NO: 899 | 705365 | 854170 | Ndr protein kinase [*Homo sapiens*] |
| SEQ ID NO: 900 | 705546 | 1667370 | protein kinase. [house mouse.] |
| SEQ ID NO: 901 | 706386 | 1181670 | Human GTP-binding protein alpha q subunit (GNAQ) mRNA, complete [human.] |
| SEQ ID NO: 902 | 706487 | 1107688 | *H. sapiens* mRNA for interferon regulatory factor 3. [human.] |
| SEQ ID NO: 903 | 707357 | 2077825 | MNK1. [human.] |
| SEQ ID NO: 904 | 709070 | 189512 | protein p78. [human.] |
| SEQ ID NO: 905 | 718593 | 190422 | protein phosphatase-2A subunit-alpha. [human.] |
| SEQ ID NO: 906 | 724339 | 437910 | *R. norvegicus* mRNA for alpha 7A integrin. [Norway rat.] |
| SEQ ID NO: 907 | 727639 | 1161230 | protocadherin-3. [Norway rat.] |
| SEQ ID NO: 908 | 727885 | 1244514 | *Mus musculus* CACCC-box binding protein BKLF mRNA, complete cds. [house mouse.] |
| SEQ ID NO: 909 | 727914 | 498727 | zinc finger protein. [human.] |
| SEQ ID NO: 910 | 728966 | 1752664 | cathepsin L. [zebrafish.] |
| SEQ ID NO: 911 | 731048 | 1665821 | Similar to *D. melanogaster* cadherin-related tumor suppressor. [human.] |
| SEQ ID NO: 912 | 734390 | 498727 | zinc finger protein. [human.] |
| SEQ ID NO: 913 | 735249 | 436564 | GTP-binding protein. [house mouse.] |
| SEQ ID NO: 914 | 736663 | 1407597 | TSC-22 protein. [human.] |
| SEQ ID NO: 915 | 737809 | 407992 | RNA helicase. [house mouse.] |
| SEQ ID NO: 916 | 751271 | 1769490 | Human kruppel-related zinc finger protein (ZNF184) mRNA, partial [human.] |
| SEQ ID NO: 917 | 751640 | 2076882 | putative endothelin receptor type B-like protein. [human.] |
| SEQ ID NO: 918 | 752848 | 456090 | effector cell protease receptor 1. [human.] |
| SEQ ID NO: 919 | 753522 | 1665793 | Similar to *S. cerevisiae* YD9335.03c protein (S54640). [human.] |
| SEQ ID NO: 920 | 754412 | 2062692 | sodium phosphate transporter. [human.] |
| SEQ ID NO: 921 | 755778 | 1877195 | Human DNA sequence from 215 PAC on chromosome X contains ESTs, [human.] |
| SEQ ID NO: 922 | 757359 | 577019 | procKr2. [chicken.] |
| SEQ ID NO: 923 | 757560 | 1658504 | Rga. [fruit fly.] |
| SEQ ID NO: 924 | 758754 | 2149603 | *Mus musculus* flotillin mRNA, complete cds. [house mouse.] |
| SEQ ID NO: 925 | 761192 | 498720 | *H. sapiens* HZF10 mRNA for zinc finger protein. [human.] |
| SEQ ID NO: 926 | 769786 | 538261 | TR4 orphan receptor. [human.] |
| SEQ ID NO: 927 | 773734 | 1841525 | ESE-1a. [human.] |
| SEQ ID NO: 928 | 774419 | 1184066 | calcium-activated chloride channel. [cow.] |
| SEQ ID NO: 929 | 775019 | 183929 | Human HEB helix-loop-helix protein (HEB) mRNA, complete cds. [*Homo sapiens* cDNA to mRNA.] |
| SEQ ID NO: 930 | 775384 | 1517820 | p56 KKIAMRE protein kinase. [human.] |
| SEQ ID NO: 931 | 775437 | 1184066 | calcium-activated chloride channel. [cow.] |
| SEQ ID NO: 932 | 775634 | 1698720 | zinc finger protein. [human.] |
| SEQ ID NO: 933 | 776025 | 516012 | PINCH protein. [human.] |
| SEQ ID NO: 934 | 777809 | 220864 | Rat PP-1a gene for catalytic subunit of protein phosphatase 1. [Rat (Fischer F344), cDNA to mRNA.] |
| SEQ ID NO: 935 | 778003 | 406738 | Shb. [human.] |
| SEQ ID NO: 936 | 778511 | 340478 | DNA-binding protein. [human.] |
| SEQ ID NO: 937 | 778806 | 2138189 | Human herpesvirus entry mediator mRNA, complete cds. [human.] |
| SEQ ID NO: 938 | 779308 | 180141 | cell surface antigen. [human.] |
| SEQ ID NO: 939 | 779596 | 1017721 | Human repressor transcriptional factor (ZNF85) mRNA, complete cds. [human.] |
| SEQ ID NO: 940 | 782996 | 186512 | *Homo sapiens* 19 (clone.2) interferon-gamma IEF 51 SSP mRNA [*Homo sapiens* cDNA to mRNA.] |
| SEQ ID NO: 941 | 785643 | 340458 | DNA-binding protein. [human.] |
| SEQ ID NO: 942 | 787082 | 1699163 | ETX1 {alternatively spliced} [human, retina, 4 Peptide, aa]. [human retina.] |
| SEQ ID NO: 943 | 791011 | 2072014 | phosphatidylinositol-4-phosphate-5-kinase. [domestic pig.] |
| SEQ ID NO: 944 | 791681 | 311337 | stimulatory GTP binding protein. [dog.] |
| SEQ ID NO: 945 | 796012 | 163225 | inositol monophosphatase. [cow.] |
| SEQ ID NO: 946 | 796375 | 498730 | *H. sapiens* HZF6 mRNA for zinc finger protein. |

TABLE 1-continued

| | | | |
|---|---|---|---|
| SEQ ID NO: 947 | 805552 | 193402 | GABA-alpha receptor delta-subunit. [house mouse.] |
| SEQ ID NO: 948 | 807267 | 1617117 | *H. sapiens* mRNA for thiol-specific antioxidant. [human.] |
| SEQ ID NO: 949 | 810389 | 495567 | Human zinc finger protein (ZNF139) mRNA, partial cds. [human.] |
| SEQ ID NO: 950 | 819550 | 1020091 | neuropsin. [house mouse.] |
| SEQ ID NO: 951 | 820694 | 532504 | stratum corneum chymotryptic enzyme. [human.] |
| SEQ ID NO: 952 | 824265 | 487840 | Zinc finger. [human.] |
| SEQ ID NO: 953 | 827431 | 2077932 | Protein Kinase. [Norway rat.] |
| SEQ ID NO: 954 | 828082 | 442421 | Human activating transcription factor 3 (ATF3) mRNA, complete cds. [*Homo sapiens* cDNA to mRNA.] |
| SEQ ID NO: 955 | 832067 | 1657265 | Human DNA sequence from 179 PAC, between markers DXS6791 and [human.] |
| SEQ ID NO: 956 | 834251 | 1136337 | leucine-zipper protein. [chicken.] |
| SEQ ID NO: 957 | 835995 | 340450 | DNA-binding protein. [human.] |
| SEQ ID NO: 958 | 836623 | 459152 | RANTES. [Norway rat.] |
| SEQ ID NO: 959 | 837890 | 1050529 | *H. sapiens* ZNF74-1 mRNA. [human.] |
| SEQ ID NO: 960 | 838332 | 1199603 | Human zinc finger protein C2H2-25 mRNA, complete cds. [human.] |
| SEQ ID NO: 961 | 839651 | 453373 | zinc finger protein. [house mouse.] |
| SEQ ID NO: 962 | 841903 | 1644377 | *H. sapiens* ICAAR gene. [human.] |
| SEQ ID NO: 963 | 842889 | 532032 | *Homo sapiens* (subclone 6 H8 from P1 35 H5 C8) DNA sequence. [*Homo sapiens* (library: Subclones in pSP72 from P1 clone 35 H5 C8] |
| SEQ ID NO: 964 | 850121 | 56392 | *R. norvegicus* mRNA for H36-alpha7 integrin alpha chain. [Norway rat.] |
| SEQ ID NO: 965 | 851571 | 498730 | *H. sapiens* HZF6 mRNA for zinc finger protein. [human.] |
| SEQ ID NO: 966 | 852401 | 189677 | Human protein C inhibitor gene, complete cds. [Homo sapiens DNA.] |
| SEQ ID NO: 967 | 852708 | 1655624 | *H. sapiens* mRNA for arginine methyltransferase. [human.] |
| SEQ ID NO: 968 | 857279 | 1314667 | CfOLF4. [dog.] |
| SEQ ID NO: 969 | 858552 | 1066920 | E03A3.2. [*Caenorhabditis elegans*.] |
| SEQ ID NO: 970 | 859876 | 1857636 | Human phosphatidylinositol-4-phosphate 5-kinase type II beta mRNA, [human.] |
| SEQ ID NO: 971 | 859906 | 1753102 | Human putative G protein-coupled receptor (GPR20) gene, complete [human.] |
| SEQ ID NO: 972 | 861034 | 1209875 | *Rattus norvegicus* Myx mRNA, complete cds. [brown rat.] |
| SEQ ID NO: 973 | 862023 | 1695802 | Human MOP3 mRNA, complete cds. [human.] |
| SEQ ID NO: 974 | 862403 | 567206 | growth factor. [house mouse.] |
| SEQ ID NO: 975 | 864259 | 2145059 | *Homo sapiens* TTF-I interacting peptide 20 mRNA, partial cds. [human.] |
| SEQ ID NO: 976 | 864272 | 531750 | probable mitochondrial protein. [baker's yeast.] |
| SEQ ID NO: 977 | 864414 | 288344 | *R. norvegicus* mRNA for inhibitory glycine receptor alpha 2A subunit. [Norway rat.] |
| SEQ ID NO: 978 | 864683 | 575361 | protein kinase PkpA. [*Phycomyces blakesleeanus*.] |
| SEQ ID NO: 979 | 865569 | 1040966 | *Rattus rattus* PCTAIRE-1 protein kinase mRNA, alternatively spliced, [black rat.] |
| SEQ ID NO: 980 | 866123 | 829619 | protein kinase [*Arabidopsis thaliana*] |
| SEQ ID NO: 981 | 866390 | 1314665 | CfOLF3. [dog.] |
| SEQ ID NO: 982 | 873352 | 1695172 | member of PDGF/VEGT family of growth factors. [house mouse.] |
| SEQ ID NO: 983 | 876063 | 56392 | *R. norvegicus* mRNA for H36-alpha7 integrin alpha chain. [Norway rat.] |
| SEQ ID NO: 984 | 877555 | 56493 | Rat mRNA for integrin alpha-1. [Norway rat.] |
| SEQ ID NO: 985 | 877705 | 340486 | DNA-binding protein. [human.] |
| SEQ ID NO: 986 | 877928 | 1161343 | interleukin 17 receptor. [house mouse.] |
| SEQ ID NO: 987 | 878146 | 1151256 | transmembrane receptor. [house mouse.] |
| SEQ ID NO: 988 | 878906 | 902886 | Ksp-cadherin [*Oryctolagus cuniculus*] |
| SEQ ID NO: 989 | 881694 | 189940 | Human phosphorylase kinase (PSK-C3) mRNA, complete cds. [Human HeLa cell line, cDNA to mRNA.] |
| SEQ ID NO: 990 | 881996 | 2145079 | *Homo sapiens* TGF-beta related neurotrophic factor receptor 2 [human.] |
| SEQ ID NO: 991 | 882035 | 2149603 | *Mus musculus* flotillin mRNA, complete cds. [house mouse.] |
| SEQ ID NO: 992 | 884071 | 1150862 | *Rattus norvegicus* Shal-related potassium channel Kv4.3 mRNA, [Norway rat.] |
| SEQ ID NO: 993 | 889096 | 1777755 | protein tyrosine phosphatase PTPCAAX1. [human.] |
| SEQ ID NO: 994 | 889949 | 841318 | mutant sterol regulatory element binding protein [*Cricetulus griseus*] |
| SEQ ID NO: 995 | 896136 | 1430822 | Ste20-like kinase. [human.] |
| SEQ ID NO: 996 | 897147 | 1769577 | A6 protein tyrosine kinase homolog. [house mouse.] |
| SEQ ID NO: 997 | 898537 | 1813876 | smoothened. [human.] |
| SEQ ID NO: 998 | 898651 | 2160295 | protein tyrosine-serine-threonine kinase. [thale cress.] |
| SEQ ID NO: 999 | 899024 | 180990 | Human cytoplasmic phosphtyrosine phosphatase mRNA. |

TABLE 1-continued

| | | | |
|---|---|---|---|
| SEQ ID NO: 1000 | 899043 | 1613847 | [*Homo sapiens* placenta cDNA to mRNA.] Human zinc finger protein zfp6 (ZF6) mRNA, partial cds. [human.] |
| SEQ ID NO: 1001 | 902631 | 38031 | Human ZNF43 mRNA. [human.] |
| SEQ ID NO: 1002 | 907157 | 1835659 | multidrug resistance-associated protein. [human.] |
| SEQ ID NO: 1003 | 915403 | 1236650 | PP-1M. [Norway rat.] |
| SEQ ID NO: 1004 | 917525 | 307328 | Human protocadherin 43 mRNA, complete cds for abbreviated PC43. [*Homo sapiens* (tissue library: Stratagene) brain cDNA to mRNA.] |
| SEQ ID NO: 1005 | 924579 | 1890117 | *Homo sapiens* casein kinase I gamma 2 mRNA, complete cds. [human.] |
| SEQ ID NO: 1006 | 924778 | 49941 | *M. musculus* mRNA for AM2 receptor. [house mouse.] |
| SEQ ID NO: 1007 | 926018 | 1086452 | MAP kinase kinase. [fruit fly.] |
| SEQ ID NO: 1008 | 926034 | 1836161 | Ca2+/calmodulin-dependent protein kinase IV kinase isoform, [*Rattus sp.* brain.] |
| SEQ ID NO: 1009 | 926250 | 387675 | protocadherin 42. [human.] |
| SEQ ID NO: 1010 | 926642 | 205106 | Rat neuronal delayed rectifier K+ channel (K-V-4) mRNA, complete [*Rattus norvegicus* (strain Sprague-Dawley) brain cDNA to mRNA.] |
| SEQ ID NO: 1011 | 927003 | 202806 | vasopressin receptor. [Norway rat.] |
| SEQ ID NO: 1012 | 927740 | 263348 | zinc finger = ZNF126 [human, Peptide Partial, 98 aa]. [human.] |
| SEQ ID NO: 1013 | 928085 | 1913900 | Human 236 clones 237 and zinc finger protein mRNA, complete [human.] |
| SEQ ID NO: 1014 | 928596 | 206189 | protein kinase C type II. [Norway rat.] |
| SEQ ID NO: 1015 | 928762 | 488557 | zinc finger protein ZNF137. [human.] |
| SEQ ID NO: 1016 | 929130 | 487736 | putative potassium channel subunit. [fruit fly.] |
| SEQ ID NO: 1017 | 930839 | 163783 | transducin beta subunit. [cow.] |
| SEQ ID NO: 1018 | 932340 | 1707017 | RNA helicase isolog. [thale cress.] |
| SEQ ID NO: 1019 | 933230 | 529400 | transcription regulator. [house mouse.] |
| SEQ ID NO: 1020 | 934370 | 1835659 | multidrug resistance-associated protein. [human.] |
| SEQ ID NO: 1021 | 937019 | 1617517 | orphan G protein-coupled receptor. [human.] |
| SEQ ID NO: 1022 | 937525 | 498727 | zinc finger protein. [human.] |
| SEQ ID NO: 1023 | 938735 | 602434 | GABA/noradrenaline transporter. [human.] |
| SEQ ID NO: 1024 | 939088 | 28638 | Human mRNA for antileukoprotease (ALP) from cervix uteri. [human.] |
| SEQ ID NO: 1025 | 939531 | 1373393 | Human zinc finger protein (LD5-1) mRNA, complete cds. [human.] |
| SEQ ID NO: 1026 | 947336 | 56392 | *R. norvegicus* mRNA for H36-alpha7 integrin alpha chain. [Norway rat.] |
| SEQ ID NO: 1027 | 949299 | 1916230 | granulocyte chemotactic protein-2. [human.] |
| SEQ ID NO: 1028 | 954226 | 1813563 | paraxis. [chicken.] |
| SEQ ID NO: 1029 | 956818 | 1468943 | AEBP1. [human.] |
| SEQ ID NO: 1030 | 959745 | 2072185 | Human osteoprotegerin (OPG) protein, complete sequence.#. [human.] |
| SEQ ID NO: 1031 | 961450 | 32455 | *H. sapiens* hR-PTPu gene for protein tyrosine phosphatase. [human.] |
| SEQ ID NO: 1032 | 965175 | 1752644 | Rat mRNA for NB-3, complete cds. [*Rattus norvegicus* (strain: Wistar) brain cDNA to mRNA.] |
| SEQ ID NO: 1033 | 965517 | 1905801 | monocyte chemotactic protein-2. [human.] |
| SEQ ID NO: 1034 | 966470 | 292936 | Human zinc finger mRNA. [*Homo sapiens* female hippocampus cDNA to mRNA.] |
| SEQ ID NO: 1035 | 968129 | 984304 | serine/threonine kinase PAK homolog DPAK [*Homo sapiens*] |
| SEQ ID NO: 1036 | 968249 | 338477 | Human zinc finger protein (SRE-ZBP) mRNA, 3' end. [*Homo sapiens* cDNA to mRNA.] |
| SEQ ID NO: 1037 | 971090 | 256854 | nek1 = serine/threonine- and tyrosine-specific protein kinase [mice, [*Mus sp.* erythroleukemia cells.] |
| SEQ ID NO: 1038 | 975377 | 1304598 | Human ring zinc-finger protein (ZNF127-Xp) gene and 5' flanking [human.] |
| SEQ ID NO: 1039 | 980625 | 1022773 | *Mus musculus* transcription factor TFEB mRNA, partial cds. [house mouse strain = C57/B6.] |
| SEQ ID NO: 1040 | 980996 | 1050332 | voltage-gated K+ channel. [Norway rat.] |
| SEQ ID NO: 1041 | 983688 | 602467 | nidogen. [human.] |
| SEQ ID NO: 1042 | 985852 | 487738 | putative potassium channel subunit. [human.] |
| SEQ ID NO: 1043 | 987281 | 1871530 | *H. sapiens* BDP1 mRNA for protein-tyrosine-phosphatase. [human.] |
| SEQ ID NO: 1044 | 988284 | 514261 | inwardly rectifying potassium channel; inward rectifier. [human.] |
| SEQ ID NO: 1045 | 995413 | 505546 | zinc-finger protein [*Homo sapiens*] |
| SEQ ID NO: 1046 | 997190 | 1161229 | *Rattus norvegicus* protocadherin-3 (pcdh3) mRNA, complete cds. [*Rattus norvegicus* (strain Sprague-Dawley) (clone: 43) adult brain] |
| SEQ ID NO: 1047 | 998550 | 902669 | olfactory receptor [*Xenopus laevis*] |
| SEQ ID NO: 1048 | 999192 | 183297 | Human glucose transport-like 5 (GLUT5) mRNA, |

TABLE 1-continued

| | | | complete cds. [Human jejunum, cDNA to mRNA.] |
|---|---|---|---|
| SEQ ID NO: 1049 | 999335 | 577019 | procKr2. [chicken.] |

| | CLONE ID | ANNOTATION |
|---|---|---|
| SEQ ID NO: 1050 | g1000887 | *Homo sapiens* protein phosphatase 2A B56-alpha mRNA, complete cds. |
| SEQ ID NO: 1051 | g1002738 | PROBABLE G PROTEIN-COUPLED RECEPTOR GPR10 [GPR10] - HUMAN |
| SEQ ID NO: 1052 | g1002740 | PROBABLE G PROTEIN-COUPLED RECEPTOR GPR9 [GPR9] (FRAGMENT) - HUMAN |
| SEQ ID NO: 1053 | g1016687 | Human IAP-like protein ILP mRNA, complete cds. |
| SEQ ID NO: 1054 | g1017721 | Human repressor transcriptional factor |
| SEQ ID NO: 1055 | g1039418 | Human tyrosine protein kinase (Jak3B) splice variant mRNA, complete cds. |
| SEQ ID NO: 1056 | g1041044 | Human olfactory receptor-like gene, complete cds |
| SEQ ID NO: 1057 | g1041933 | RFC1 = reduced folate carrier {coding region} [human, testis, mRNA 17 Partial, nt] |
| SEQ ID NO: 1058 | g1050529 | *H. sapiens* ZNF74-1 mRNA. |
| SEQ ID NO. 1059 | g1053068 | Human retinoid X receptor-gamma mRNA, complete cds. |
| SEQ ID NO: 1060 | g1055280 | Human Rab27 mRNA, complete cds. |
| SEQ ID NO: 1061 | g1063629 | NEUROPEPTIDE Y TYPE 4 (NPY4-R) [NPY4R] - HUMAN |
| SEQ ID NO: 1062 | g1063633 | NEUROPEPTIDE Y TYPE 2 (NPY2-R) [NPY2R] - HUMAN |
| SEQ ID NO: 1063 | g1066050 | GASTRIC INHIBITORY PEPTIDE (GIP-R) [GIPR] - HUMAN |
| SEQ ID NO: 1064 | g1066730 | *Homo sapiens* (clone GPCR W) G protein-linked receptor gene (GPCR) gene, 5' end of cds |
| SEQ ID NO: 1065 | g1079575 | Human seven trans-membrane domain protein (AD3LP/AD5) mRNA, complete cds. |
| SEQ ID NO: 1066 | g1107686 | *H. sapiens* mRNA for hFat protein. |
| SEQ ID NO: 1067 | g1122930 | Human serine-threonine phosphatase (PP5) mRNA, partial cds. |
| SEQ ID NO: 1068 | g1124904 | URIDINE NUCLEOTIDE RECEPTOR (UNR) (P2P) (P2Y4) [P2RY4] - HUMAN |
| SEQ ID NO: 1069 | g1136797 | Human MAP kinase Mxi2 (MXI2) mRNA |
| SEQ ID NO: 1070 | g1144507 | Human corticotropin-releasing factor receptor 2 mRNA, complete cds. |
| SEQ ID NO: 1071 | g1146128 | Human integrin-linked kinase (ILK) mRNA, complete cds. |
| SEQ ID NO: 1072 | g1149557 | Human TNF-related apoptosis inducing ligand TRAIL mRNA, complete cds. |
| SEQ ID NO: 1073 | g1154851 | *H. sapiens* rab28 mRNA. |
| SEQ ID NO: 1074 | g1160182 | + METABOTROPIC GLUTAMATE 4 [GRM4; MGLUR4] - HUMAN |
| SEQ ID NO: 1075 | g1160928 | *Homo sapiens* cytoplasmic antiproteinase 3 (CAP3) mRNA, complete cds. |
| SEQ ID NO: 1076 | g1160974 | *Homo sapiens* TNFR2-TRAF signalling complex protein mRNA, complete cds. |
| SEQ ID NO: 1077 | g1162923 | 5-HYDROXYTRYPTAMINE 6 (5-HT-6) [HTR6] - HUMAN |
| SEQ ID NO: 1078 | g1166511 | regulator of G-protein signaling similarity |
| SEQ ID NO: 1079 | g1171145 | PROBABLE G PROTEIN-COUPLED RECEPTOR GPR15 [GPR15] - HUMAN |
| SEQ ID NO: 1080 | g1171563 | + METABOTROPIC GLUTAMATE 3 [GRM3; MGLUR3] - HUMAN |
| SEQ ID NO: 1081 | g1174071 | Human G alpha-q (Gaq) mRNA, complete cds |
| SEQ ID NO: 1082 | g1174146 | Human small GTP binding protein Rab9 mRNA, complete cds. |
| SEQ ID NO: 1083 | g1174148 | Human small GTP binding protein Rab7 mRNA, complete cds. |
| SEQ ID NO: 1084 | g1184861 | Human dishevelled homolog (DVL) mRNA, complete cds. |
| SEQ ID NO: 1085 | g1199579 | C-C CHEMOKINE RECEPTOR TYPE 3 (C-C CKR-3) [CMKBR3] - HUMAN |
| SEQ ID NO: 1086 | g1199603 | Human zinc finger protein C2H2-25 mRNA, complete cds. |
| SEQ ID NO: 1087 | g1203817 | Human MAP kinase kinase 6 (MKK6) mRNA |
| SEQ ID NO: 1088 | g1209017 | Human MAPKAP kinase (3pK) mRNA, complete cds. |
| SEQ ID NO: 1089 | g1209672 | Human MAP kinase kinase 6b mRNA |
| SEQ ID NO: 1090 | g1216368 | RGP3 |
| SEQ ID NO: 1091 | g1216372 | RGP4 |
| SEQ ID NO: 1092 | g1217590 | Human mRNA for human transcription elongation factor S-II, hS-II-T1. |
| SEQ ID NO: 1093 | g1220312 | *Homo sapiens* interleukin-1 receptor-associated kinase (IRAK) mRNA, complete cds. |
| SEQ ID NO: 1094 | g1245045 | Human 1 specific-kDa vacuolar proton pump subunit (OC-116KDa) mRNA, complete cds. |
| SEQ ID NO: 1095 | g1245054 | PROBABLE G PROTEIN-COUPLED RECEPTOR GPR-9-6 - HUMAN |
| SEQ ID NO: 1096 | g1245056 | PROBABLE G PROTEIN-COUPLED RECEPTOR GPR-CY6 (TER1) - HUMAN |
| SEQ ID NO: 1097 | g1245058 | PROBABLE G PROTEIN-COUPLED RECEPTOR GPR-CY4 - HUMAN |
| SEQ ID NO: 1098 | g1245391 | Human calcium, calmodulin-dependent protein kinase II beta mRNA, partial cds. |
| SEQ ID NO: 1099 | g1246754 | *H. sapiens* mRNA for cyclic nucleotide phosphodiesterase. |
| SEQ ID NO: 1100 | g1255784 | Human MAP kinase phosphatase (MKP-2) |
| SEQ ID NO: 1101 | g1256002 | Human tyrosine kinase (Tnk1) mRNA, complete cds. |
| SEQ ID NO: 1102 | g1256016 | Human sodium channel 1 (BNC1) mRNA, complete cds. |
| SEQ ID NO: 1103 | g1256386 | Human G protein-activated inwardly rectifying potassium channel HGIRK1/Kir3.1 mRNA, complete cds. |
| SEQ ID NO: 1104 | g1262810 | C-C CHEMOKINE RECEPTOR TYPE 5 (C-C CKR-5) [CMKBR5] - HUMAN |
| SEQ ID NO: 1105 | g1276900 | Human Rho-associated, coiled-coil containing protein kinase p160ROCK mRNA, complete cds. |
| SEQ ID NO: 1106 | g1293897 | Human zinc-finger protein (ZNF76) gene, partial cds. |
| SEQ ID NO: 1107 | g1296608 | *H. sapiens* mRNA for chemokine CC-2 and CC-1. |
| SEQ ID NO: 1108 | g1296659 | *H. sapiens* mRNA for P2Y6 receptor. |
| SEQ ID NO: 1109 | g1310668 | *H. sapiens* HOK-2 gene, exon 2. |
| SEQ ID NO: 1110 | g1321593 | *Homo sapiens* (clone HSNME29) CGRP type 1 receptor mRNA, complete cds |
| SEQ ID NO: 1111 | g1323695 | PROBABLE G PROTEIN-COUPLED RECEPTOR GPR19 (GPR-NGA) [GPR19] - HUMAN |
| SEQ ID NO: 1112 | g1326154 | Human melatonin-related receptor mRNA, complete cds |
| SEQ ID NO: 1113 | g1335855 | Human 5'-AMP-activated protein kinase, gamma-1 subunit mRNA, complete cds. |

TABLE 1-continued

| SEQ ID NO: | ID | Description |
|---|---|---|
| SEQ ID NO: 1114 | g1336040 | olfactory receptor (OLF1) |
| SEQ ID NO: 1115 | g1336042 | Human olfactory receptor (OLF3) gene, complete cds |
| SEQ ID NO: 1116 | g1339917 | Human adult skeletal muscle mRNA for TR3 |
| SEQ ID NO: 1117 | g1370103 | C-C CHEMOKINE RECEPTOR TYPE 4 (C-C CKR-4) [CMKBR4] - HUMAN |
| SEQ ID NO: 1118 | g1370110 | + METABOTROPIC GLUTAMATE 7 [GRM7; MGLUR7] - HUMAN |
| SEQ ID NO: 1119 | g1373018 | Human cysteine-rich fibroblast growth factor receptor (CFR-1) mRNA, complete cds. |
| SEQ ID NO: 1120 | g1377819 | Human myosin light chain kinase (MLCK) mRNA, complete cds. |
| SEQ ID NO: 1121 | g1381668 | Human IL8-related receptor (DRY12) mRNA, complete cds. |
| SEQ ID NO: 1122 | g1381807 | Human skeletal muscle LIM-protein SLIM1 mRNA, complete cds. |
| SEQ ID NO: 1123 | g1387999 | B2 BRADYKININ (BK-2R) [BDKRB2; BKR2] - HUMAN |
| SEQ ID NO: 1124 | g1388194 | Human low-Mr GTP-binding protein (RAB31) mRNA, complete cds. |
| SEQ ID NO: 1125 | g1389852 | Human cadherin-14 mRNA, complete cds. |
| SEQ ID NO: 1126 | g1399100 | Human phosphatidylinositol (4,5)bisphosphate 5-phosphatase homolog mRNA, partial cds. |
| SEQ ID NO: 1127 | g1399104 | Human phosphatidylinositol (4,5)bisphosphate 5-phosphatase homolog mRNA, partial cds. |
| SEQ ID NO: 1128 | g1399196 | Human pyruvate dehydrogenase kinase isoform 4 mRNA, complete cds. |
| SEQ ID NO: 1129 | g1399211 | Human K-Cl cotransporter (hKCC1) mRNA, complete cds. |
| SEQ ID NO: 1130 | g1399461 | Human serine/threonine-protein kinase PRP4h (PRP4h) mRNA, complete cds. |
| SEQ ID NO: 1131 | g1405318 | Human Liver mRNA for interferon-gamma inducing factor(IGIF), complete cds. |
| SEQ ID NO: 1132 | g1407624 | Human protein tyrosine phosphatase PTPsigma (PTPsigma) mRNA, complete cds. |
| SEQ ID NO: 1133 | g1408051 | METABOTROPIC GLUTAMATE 5 [GRM5; MGLUR5] - HUMAN |
| SEQ ID NO: 1134 | g1418931 | H. sapiens mRNA for phosphotyrosine phosphatase kappa. |
| SEQ ID NO: 1135 | g1418933 | H. sapiens mRNA for protein-tyrosine-phosphatase (tissue type: foreskin). |
| SEQ ID NO: 1136 | g1432176 | Human peroxisome proliferator activated receptor gamma 2 mRNA, complete cds. |
| SEQ ID NO: 1137 | g1438903 | NEUROPEPTIDE Y TYPE 5 (NPY5-R) [NPY5R] - HUMAN |
| SEQ ID NO: 1138 | g1463025 | Human channel associated protein of synapse (chapsyn-110) mRNA, complete cds. |
| SEQ ID NO: 1139 | g1463130 | Human JNK1 alpha2 protein kinase (JNK1A2) mRNA, complete cds. |
| SEQ ID NO: 1140 | g1469305 | Human p38Beta MAP kinase mRNA, complete cds. |
| SEQ ID NO: 1141 | g1469897 | BLUE-SENSITIVE OPSIN [BCP] - HUMAN |
| SEQ ID NO: 1142 | g1477788 | Human stress responsive serine/threonine protein kinase Krs-1 mRNA, complete cds. |
| SEQ ID NO: 1143 | g1478280 | Human neutral amino acid transporter B mRNA, complete cds. |
| SEQ ID NO: 1144 | g1478492 | prIL-16 = putative interleukin-16 precursor [human, mRNA 11 Partial, nt]. |
| SEQ ID NO: 1145 | g1479978 | Homo sapiens STAT4 mRNA, complete cds. |
| SEQ ID NO: 1146 | g1480860 | Human serine/threonine protein kinase (LKB1) mRNA, complete cds. |
| SEQ ID NO: 1147 | g1488262 | Human putative serine/threonine protein kinase PRK (prk) mRNA, complete cds. |
| SEQ ID NO: 1148 | g1504140 | GROWTH HORMONE SECRETAGOGUE TYPE 1 - HUMAN |
| SEQ ID NO: 1149 | g1514596 | H. sapiens mRNA for 52 kD subunit of transcription factor TFIIH. |
| SEQ ID NO: 1150 | g1518529 | Human ATP-dependent inwardly rectifying potassium channel Kir4.1 mRNA, complete cds. |
| SEQ ID NO: 1151 | g1524087 | H. sapiens PRR2 mRNA. |
| SEQ ID NO: 1152 | g1524091 | Human mRNA for adenosine triphosphatase, |
| SEQ ID NO: 1153 | g1524108 | H. sapiens mRNA for TIF1beta zinc finger protein. |
| SEQ ID NO: 1154 | g1526977 | Human mRNA for ryanodine receptor 2. |
| SEQ ID NO: 1155 | g1526989 | Human cAMP-dependent protein kinase type |
| SEQ ID NO: 1156 | g1531982 | H. sapiens mRNA for CC-chemokine, eotaxin variant (clone 53). |
| SEQ ID NO: 1157 | g1546083 | Human farnesol receptor HRR-1 (HRR-1) mRNA, complete cds. |
| SEQ ID NO: 1158 | g1575003 | Human Na,K-ATPase gamma subunit mRNA, complete cds. |
| SEQ ID NO: 1159 | g1575791 | Human low-Mr GTP-binding protein Rab32 (RAB32) mRNA, complete cds. |
| SEQ ID NO: 1160 | g1613843 | Human HsPex13p mRNA, complete cds. |
| SEQ ID NO: 1161 | g1621456 | Human interferon regulatory factor 7 (humirf7) mRNA, complete cds. |
| SEQ ID NO: 1162 | g1638834 | H. sapiens mRNA for vacuolar-type 1 H(+)-ATPase kDa subunit. |
| SEQ ID NO: 1163 | g1655914 | Human transcription factor hGATA-6 mRNA, complete cds. |
| SEQ ID NO: 1164 | g1679601 | Edg-2 G protein-coupled receptor |
| SEQ ID NO: 1165 | g1694672 | Human mRNA for proton-ATPase-like protein, complete cds. |
| SEQ ID NO: 1166 | g1698719 | Human zinc finger protein mRNA, complete cds. |
| SEQ ID NO: 1167 | g1703639 | GCN5-like 1 = GCN5 homolog/putative regulator of transcriptional activation {clone GCN5L1} [human, 5 mRNA, nt]. |
| SEQ ID NO: 1168 | g1710134 | Human Box-dependent MYC-interacting protein-1 (BIN1) mRNA, complete cds. |
| SEQ ID NO: 1169 | g1731789 | neuropeptide Y/peptide YY Y6 receptor |
| SEQ ID NO: 1170 | g177771 | 5-HYDROXYTRYPTAMINE 1D (5-HT-1D) (5-HT-1D-ALPHA) [HTR1D; HTR1DA] - HUMAN |
| SEQ ID NO: 1171 | g177773 | 5-HYDROXYTRYPTAMINE 1E (5-HT-1E) (S31) [HTR1E] - HUMAN |
| SEQ ID NO: 1172 | g177806 | ALPHA-1A ADRENERGIC [ADRA1A] - HUMAN |
| SEQ ID NO: 1173 | g177865 | Human tumor necrosis factor alpha inducible protein A20 mRNA, complete cds. |
| SEQ ID NO: 1174 | g177869 | Human alpha-2-macroglobulin mRNA, complete cds. |
| SEQ ID NO: 1175 | g177889 | Human alpha-2-thiol proteinase inhibitor mRNA, complete |

TABLE 1-continued

| | | coding sequence. |
|---|---|---|
| SEQ ID NO: 1176 | g177987 | MUSCARINIC ACETYLCHOLINE M5 [CHRM5] - HUMAN |
| SEQ ID NO: 1177 | g177989 | MUSCARINIC ACETYLCHOLINE M2 [CHRM2] - HUMAN |
| SEQ ID NO: 1178 | g177991 | MUSCARINIC ACETYLCHOLINE M4 [CHRM4] - HUMAN |
| SEQ ID NO: 1179 | g178149 | ADENOSINE A2B [ADORA2B] - HUMAN |
| SEQ ID NO: 1180 | g178195 | ALPHA-2A ADRENERGIC (SUBTYPE C10) [ADRA2A; ADRA2R; ADRAR] - HUMAN |
| SEQ ID NO: 1181 | g178197 | ALPHA-2B ADRENERGIC (SUBTYPE C2) [ADRA2B] - HUMAN |
| SEQ ID NO: 1182 | g178199 | BETA-1 ADRENERGIC [ADRB1; ADRB1R; B1AR] - HUMAN |
| SEQ ID NO: 1183 | g178251 | Human epidermal growth factor receptor-related gene, 5' end. |
| SEQ ID NO: 1184 | g178895 | BETA-3 ADRENERGIC [ADRB3; ADRB3R; B3AR] - HUMAN |
| SEQ ID NO: 1185 | g178984 | Human ADP-ribosylation factor 4 (ARF4) mRNA, complete cds. |
| SEQ ID NO: 1186 | g179078 | Human asialoglycoprotein receptor H1 mRNA, complete cds. |
| SEQ ID NO: 1187 | g179121 | TYPE-1A ANGIOTENSIN II (AT1A) [AGTR1; AT2R1] - HUMAN |
| SEQ ID NO: 1188 | g179699 | C5A ANAPHYLATOXIN CHEMOTACTIC (C5A-R) (CD88) [C5R1] - HUMAN |
| SEQ ID NO: 1189 | g179879 | CALCITONIN (CT-R) [CALCR] - HUMAN |
| SEQ ID NO: 1190 | g179984 | C-C CHEMOKINE RECEPTOR TYPE 1 (C-C CKR-1) [CMKBR1; CMKR1] - HUMAN |
| SEQ ID NO: 1191 | g180110 | Human antigen CD36 (clone 13) mRNA, comp |
| SEQ ID NO: 1192 | g180463 | cGMP phosphodiesterase alpha subunit (CGPR-A) |
| SEQ ID NO: 1193 | g180696 | RED-SENSITIVE OPSIN [RCP] - HUMAN |
| SEQ ID NO: 1194 | g181040 | Human cAMP response element regulatory protein (CREB2) mRNA, complete cds. |
| SEQ ID NO: 1195 | g181145 | Human T-cell granulocyte-macrophage colony stimulating factor (GM-CSF) mRNA. |
| SEQ ID NO: 1196 | g181175 | connective tissue activation peptide III (PBP) |
| SEQ ID NO: 1197 | g181431 | Human dopamine D2 receptor, mRNA, complete cds. |
| SEQ ID NO: 1198 | g181546 | *Homo sapiens* defensin 6 mRNA, complete cds. |
| SEQ ID NO: 1199 | g181907 | E16 |
| SEQ ID NO: 1200 | g181946 | erythroid differentiation protein |
| SEQ ID NO: 1201 | g181948 | PROBABLE G PROTEIN-COUPLED RECEPTOR EDG-1 [EDG1] - HUMAN |
| SEQ ID NO: 1202 | g182066 | Human translational initiation factor 2 beta subunit (eIF-2-beta) mRNA, complete cds. |
| SEQ ID NO: 1203 | g182275 | ENDOTHELIN B (ET-B) (ENDOTHELIN NON-SELECTIVE TYPE) [EDNRB; ETRB] - HUMAN |
| SEQ ID NO: 1204 | g182482 | Human fibroblast collagenase inhibitor mRNA, complete cds. |
| SEQ ID NO: 1205 | g182662 | FMET-LEU-PHE (FMLP-R) (N-FORMYL PEPTIDE) (FPR) [FPR1] - HUMAN |
| SEQ ID NO: 1206 | g182666 | FMLP-RELATED II (FMLP-R-II) [FPRL2] - HUMAN |
| SEQ ID NO: 1207 | g182668 | FMLP-RELATED I (FMLP-R-I) [FPRL1] - HUMAN |
| SEQ ID NO: 1208 | g182709 | Human fibronectin receptor (FnR) alpha-subunit gene, 3' end. |
| SEQ ID NO: 1209 | g182770 | Human follicle stimulating hormone receptor mRNA, complete cds. |
| SEQ ID NO: 1210 | g183063 | Human glia-derived nexin (GDN) mRNA, 5' end. |
| SEQ ID NO: 1211 | g183172 | GROWTH HORMONE-RELEASING HORMONE (GRFR) [GHRHR] - HUMAN |
| SEQ ID NO: 1212 | g183269 | glucagon |
| SEQ ID NO: 1213 | g183421 | GONADOTROPIN-RELEASING HORMONE (GRH-R) [GNRHR] - HUMAN |
| SEQ ID NO: 1214 | g183484 | EBV-INDUCED G PROTEIN-COUPLED RECEPTOR 1 (EBI1) [EBI1; EVI1] - HUMAN |
| SEQ ID NO: 1215 | g183649 | GASTRIN-RELEASING PEPTIDE (GRP-R) (GRP-PREFERRING BOMBESIN) [GRPR] - HUMAN |
| SEQ ID NO: 1216 | g183974 | Human HepG2 glucose transport gene, exon |
| SEQ ID NO: 1217 | g184087 | HISTAMINE H2 (GASTRIC RECEPTOR I) [HRH2] - HUMAN |
| SEQ ID NO: 1218 | g186270 | Human interleukin 10 (IL10) mRNA, complete cds. |
| SEQ ID NO: 1219 | g186289 | Human interleukin 1 receptor mRNA, compl |
| SEQ ID NO: 1220 | g186342 | Human interleukin 5 receptor alpha-subunit (IL5R) mRNA, complete cds. |
| SEQ ID NO: 1221 | g186385 | Human interleukin 1 receptor antagonist gene, complete cds. |
| SEQ ID NO: 1222 | g186496 | Human integrin alpha-3 chain mRNA, compl |
| SEQ ID NO: 1223 | g186512 | *Homo sapiens* 19 (clone.2) interferon-gamma IEF 51 SSP mRNA, complete cds. |
| SEQ ID NO: 1224 | g187297 | MAL protein gene |
| SEQ ID NO: 1225 | g187388 | MAS PROTO-ONCOGENE [MAS1; MAS] - HUMAN |
| SEQ ID NO: 1226 | g188558 | macrophage inflammatory protein-1alpha |
| SEQ ID NO: 1227 | g188568 | Human MAP kinase kinase mRNA |
| SEQ ID NO: 1228 | g188673 | MELANOCORTIN-3 (MC3-R) [MC3R] - HUMAN |
| SEQ ID NO: 1229 | g189043 | Human zinc finger protein 42 (MZF-1) mRNA, complete cds. |
| SEQ ID NO: 1230 | g189134 | SUBSTANCE-K (SKR) (NEUROKININ A) (NK-2R) [TAC2R; NK2R] - HUMAN |
| SEQ ID NO: 1231 | g189155 | NEUROPEPTIDE Y TYPE 1 (NPY1-R) [NPY1R; NPYR; NPYY1] - HUMAN |
| SEQ ID NO: 1232 | g189237 | Human neuroleukin mRNA, complete cds. |
| SEQ ID NO: 1233 | g189241 | NEUROMEDIN-B (NMB-R) (NEUROMEDIN-B-PREFERRING BOMBESIN) [NMBR] - HUMAN |
| SEQ ID NO: 1234 | g189259 | Human nitric oxide synthase mRNA |
| SEQ ID NO: 1235 | g189313 | PROBABLE G PROTEIN-COUPLED RECEPTOR LCR1 HOMOLOG (FB22) (NPYRL) (LESTR) (FUSIN) - HUMAN |
| SEQ ID NO: 1236 | g189389 | *Homo sapiens* osteogenic protein-2 (OP-2) mRNA, |

TABLE 1-continued

| | | |
|---|---|---|
| SEQ ID NO: 1237 | g189391 | complete cds.<br>PUTATIVE TACHYKININ RECEPTOR - HUMAN |
| SEQ ID NO: 1238 | g189410 | oxytocin/neurophysin |
| SEQ ID NO: 1239 | g189537 | PLATELET ACTIVATING FACTOR (PAF-R)<br>[PTAFR; PAFR] - HUMAN |
| SEQ ID NO: 1240 | g189675 | Human vacuolar H+ ATPase proton channel subunit mRNA,<br>complete cds. |
| SEQ ID NO: 1241 | g189846 | Human perforin mRNA, complete cds. |
| SEQ ID NO: 1242 | g189850 | platelet factor 4 (oncostatin A) |
| SEQ ID NO: 1243 | g189927 | 5-HYDROXYTRYPTAMINE 1A (5-HT-1A) [HTR1A] - HUMAN |
| SEQ ID NO: 1244 | g189934 | Human progesterone receptor mRNA, complete cds. |
| SEQ ID NO: 1245 | g190003 | Phospholipase A2 |
| SEQ ID NO: 1246 | g190035 | Phospholipase cg2 |
| SEQ ID NO: 1247 | g190037 | Phospholipase cg1 |
| SEQ ID NO: 1248 | g190039 | Phospholipase cb2 |
| SEQ ID NO: 1249 | g190337 | Huma elafin gene, complete cds. |
| SEQ ID NO: 1250 | g190687 | Human pancreatic secretory trypsin inhibitor (PSTI) mRNA,<br>complete cds. |
| SEQ ID NO: 1251 | g190695 | Human prothymosin alpha mRNA (ProT-alpha), complete cds. |
| SEQ ID NO: 1252 | g190717 | parathyroid hormone like protein |
| SEQ ID NO: 1253 | g190721 | PARATHYROID HORMONE/PARATHYROID HORMONE-RELATED<br>PEPTIDE [PTHR] - HUMAN |
| SEQ ID NO: 1254 | g190738 | Human protein tyrosine phosphatase (PTPa |
| SEQ ID NO: 1255 | g190878 | Human ras-like protein mRNA, complete cds, clone TC4. |
| SEQ ID NO: 1256 | g219405 | ALPHA-2C-2 ADRENERGIC - HUMAN |
| SEQ ID NO: 1257 | g219649 | ENDOTHELIN-1 (ET-A) [EDNRA; ETRA] - HUMAN |
| SEQ ID NO: 1258 | g219678 | 5-HYDROXYTRYPTAMINE 1B (5-HT-1B) (5-HT-1D-BETA) (S12)<br>[HTR1B; HTR1DB] - HUMAN |
| SEQ ID NO: 1259 | g219866 | PROBABLE G PROTEIN-COUPLED RECEPTOR HM74 - HUMAN |
| SEQ ID NO: 1260 | g219991 | Human mRNA for scavenger receptor type II (phSR2). |
| SEQ ID NO: 1261 | g220080 | Human (2'-5')Oligoadenylate synthetase (2-5A synthetase),<br>complete cDNA. |
| SEQ ID NO: 1262 | g237994 | SUBSTANCE-P (SPR) (NK-1R) [TAC1R; NK1R] - HUMAN |
| SEQ ID NO: 1263 | g23878 | Human 40 kDa protein kinase related to r |
| SEQ ID NO: 1264 | g244209 | MAS-RELATED MRG - HUMAN |
| SEQ ID NO: 1265 | g246904 | NEUROMEDIN K (NKR) (NEUROKININ B) (NK-3R)<br>[TAC3R; NK3R] - HUMAN |
| SEQ ID NO: 1266 | g249370 | laminin receptor homolog {3' region} [human,<br>mRNA 7 Partial, nt]. |
| SEQ ID NO: 1267 | g256154 | ADENOSINE A1 [ADORA1] - HUMAN |
| SEQ ID NO: 1268 | g260878 | ICAM-3 = intercellular adhesion molecule<br>[human, 17 mRNA, nt] |
| SEQ ID NO: 1269 | g28417 | VASOPRESSIN V2 (RENAL-TYPE ARGININE VASOPRESSIN)<br>(AVPR V2) [AVPR2; ADHR; V2R] - HUMAN |
| SEQ ID NO: 1270 | g285994 | ORF |
| SEQ ID NO: 1271 | g28638 | Human mRNA for antileukoprotease (ALP) from cervix uterus. |
| SEQ ID NO: 1272 | g28679 | H. sapiens mRNA for amphiglycan. |
| SEQ ID NO: 1273 | g288396 | MCP-3 |
| SEQ ID NO: 1274 | g288931 | D(1A) DOPAMINE [DRD1] - HUMAN |
| SEQ ID NO: 1275 | g291876 | BOMBESIN SUBTYPE-3 (BRS-3) [BRS3] - HUMAN |
| SEQ ID NO: 1276 | g291945 | D(4) DOPAMINE (D(2C) DOPAMINE) [DRD4] - HUMAN |
| SEQ ID NO: 1277 | g291977 | MELANOCORTIN-4 (MC4-R) [MC4R] - HUMAN |
| SEQ ID NO: 1278 | g292054 | Helix-loop-helix basic phosphoprotein |
| SEQ ID NO: 1279 | g292056 | EBV-INDUCED G PROTEIN-COUPLED RECEPTOR 2 (EBI2)<br>[EBI2] - HUMAN |
| SEQ ID NO: 1280 | g292276 | Homo sapiens lymphotoxin-beta mRNA, complete cds. |
| SEQ ID NO: 1281 | g292418 | G PROTEIN-COUPLED RECEPTOR RDC1 HOMOLOG - HUMAN |
| SEQ ID NO: 1282 | g29370 | BETA-2 ADRENERGIC [ADRB2; ADRB2R; B2AR] - HUMAN |
| SEQ ID NO: 1283 | g297101 | H. sapiens mRNA PCTAIRE-3 for serine/threonine<br>protein kinase. |
| SEQ ID NO: 1284 | g297411 | H. sapiens thrombin inhibitor mRNA. |
| SEQ ID NO: 1285 | g298096 | H. sapiens subunit of coatomer complex. |
| SEQ ID NO: 1286 | g298201 | tissue inhibitor of metalloproteinase 2<br>[human, 10 mRNA, nt] |
| SEQ ID NO: 1287 | g29850 | Human CDw40 mRNA for nerve growth factor receptor-related<br>B-lymphocyte activation molecule. |
| SEQ ID NO: 1288 | g29878 | Human c-erbA-1 mRNA for thyroid hormone receptor alpha. |
| SEQ ID NO: 1289 | g29887 | Human mRNA for cystic fibrosis antigen (CFAg). |
| SEQ ID NO: 1290 | g299704 | BL34 = B cell activation gene |
| SEQ ID NO: 1291 | g29980 | H. sapiens 1 CL mRNA for protein tyrosine phosphatase. |
| SEQ ID NO: 1292 | g30263 | H. sapiens CST4 gene for Cystatin D. |
| SEQ ID NO: 1293 | g303596 | Human mRNA for GC-Box binding protein BTEB2, complete cds. |
| SEQ ID NO: 1294 | g306472 | Homo sapiens DHP-sensitive calcium channel gamma subunit<br>(CACNLG) mRNA, complete cds. |
| SEQ ID NO: 1295 | g306488 | GASTRIN/CHOLECYSTOKININ TYPE B (CCK-B-R)<br>[CCKBR; CCKRB] - HUMAN |
| SEQ ID NO: 1296 | g306490 | CHOLECYSTOKININ TYPE A (CCK-A-R)<br>[CCKAR; CCKRA] - HUMAN |
| SEQ ID NO: 1297 | g306688 | D(3) DOPAMINE [DRD3] - HUMAN |

TABLE 1-continued

| SEQ ID NO: | Accession | Description |
|---|---|---|
| SEQ ID NO: 1298 | g306804 | Human G protein-coupled receptor kinase (GRK5) mRNA, complete cds. |
| SEQ ID NO: 1299 | g307044 | Human interleukin-13 gene sequence with four exons. |
| SEQ ID NO: 1300 | g307152 | Human Mac-2 binding protein mRNA, comple |
| SEQ ID NO: 1301 | g307419 | 5-HYDROXYTRYPTAMINE 1F (5-HT-1F) [HTR1F] - HUMAN |
| SEQ ID NO: 1302 | g307433 | SOMATOSTATIN TYPE 1 (SS1R) (SRIF-2) [SSTR1] - HUMAN |
| SEQ ID NO: 1303 | g307435 | SOMATOSTATIN TYPE 2 (SS2R) (SRIF-1) [SSTR2] - HUMAN |
| SEQ ID NO: 1304 | g308764 | Human voltage-gated potassium channel (HK2) mRNA, complete cds. |
| SEQ ID NO: 1305 | g31192 | *H. sapiens* mRNA for epithelin 1 and 2. |
| SEQ ID NO: 1306 | g312394 | *H. sapiens* mRNA for beta-adrenergic kinase 2. |
| SEQ ID NO: 1307 | g31654 | pregastrin |
| SEQ ID NO: 1308 | g31741 | Human gene for alpha-subunit of Gi2 exon |
| SEQ ID NO: 1309 | g31912 | Human mRNA for coupling protein G(s) alp |
| SEQ ID NO: 1310 | g32048 | D(1B) DOPAMINE (D(5) DOPAMINE) [DRD5] - HUMAN |
| SEQ ID NO: 1311 | g32066 | *H. sapiens* HePTP mRNA for tyrosine phosphatase. |
| SEQ ID NO: 1312 | g32085 | OLFACTORY RECEPTOR-LIKE PROTEIN HGMP07I - HUMAN |
| SEQ ID NO: 1313 | g32092 | OLFACTORY RECEPTOR-LIKE PROTEIN HGMP07J - HUMAN |
| SEQ ID NO: 1314 | g32323 | MUSCARINIC ACETYLCHOLINE M3 [CHRM3] - HUMAN |
| SEQ ID NO: 1315 | g337751 | Human cystatin SA-I mRNA, complete cds. |
| SEQ ID NO: 1316 | g337933 | Human stem cell factor mRNA, complete cds |
| SEQ ID NO: 1317 | g338027 | 5-HYDROXYTRYPTAMINE 2C (5-HT-2C) (5-HT-1C) [HTR1C] - HUMAN |
| SEQ ID NO: 1318 | g338056 | Human sulfated glycoprotein-2 mRNA, 3'end. |
| SEQ ID NO: 1319 | g33833 | Human IL-4-R mRNA for the interleukin 4 receptor. |
| SEQ ID NO: 1320 | g338477 | Human zinc finger protein (SRE-ZBP) mRNA, 3' end. |
| SEQ ID NO: 1321 | g338498 | SOMATOSTATIN TYPE 3 (SS3R) [SSTR3] - HUMAN |
| SEQ ID NO: 1322 | g33917 | Human mRNA for gamma-interferon inducible early response gene (with homology to platelet proteins). |
| SEQ ID NO: 1323 | g339195 | Human transcobalamin II (TCII) mRNA, complete cds. |
| SEQ ID NO: 1324 | g33941 | *H. sapiens* mRNA for integrin alpha6 subunit. |
| SEQ ID NO: 1325 | g339420 | Human T cell-specific protein (RANTES) mRNA, complete cds. |
| SEQ ID NO: 1326 | g33950 | Human mRNA for integrin beta 4. |
| SEQ ID NO: 1327 | g339559 | Human transforming growth factor-beta (tgf-beta) mRNA, complete cds. |
| SEQ ID NO: 1328 | g339676 | THROMBIN [F2R OR TR] - HUMAN |
| SEQ ID NO: 1329 | g339728 | secreted protein (I-309) |
| SEQ ID NO: 1330 | g33984 | Human mRNA for second protein of inter-alpha-trypsin inhibitor complex. |
| SEQ ID NO: 1331 | g339991 | Human tumor necrosis factor-inducible (TSG-14) mRNA, complete cds. |
| SEQ ID NO: 1332 | g340198 | Human voltage-dependent anion channel is |
| SEQ ID NO: 1333 | g340200 | Human voltage-dependent anion channel isoform 2 (VDAC) mRNA, complete cds. |
| SEQ ID NO: 1334 | g340298 | vasopressin |
| SEQ ID NO: 1335 | g34030 | Human mRNA for a presumptive KDEL receptor. |
| SEQ ID NO: 1336 | g340443 | Human zinc finger protein 41 (ZNF41) gene, 3' end. |
| SEQ ID NO: 1337 | g340445 | Human zinc-finger protein 7 (ZFP7) mRNA, complete cds. |
| SEQ ID NO: 1338 | g34271 | Human mRNA for potential laminin-binding protein (nem/1cHD4). |
| SEQ ID NO: 1339 | g34450 | MUSCARINIC ACETYLCHOLINE M1 [CHRM1] - HUMAN |
| SEQ ID NO: 1340 | g34518 | interleukin 8 [*Homo sapiens*] |
| SEQ ID NO: 1341 | g34658 | macrophage inflammatory protein-2 |
| SEQ ID NO: 1342 | g34764 | OXYTOCIN (OTR) [OXTR] - HUMAN |
| SEQ ID NO: 1343 | g34790 | MELANOCYTE STIMULATING HORMONE (MSH-R) [MC1R; MSHR] - HUMAN |
| SEQ ID NO: 1344 | g349268 | fetal brain type I adenylyl cyclase |
| SEQ ID NO: 1345 | g349448 | ADENOSINE A3 [ADORA3] - HUMAN |
| SEQ ID NO: 1346 | g35020 | NEUROTENSIN (NT-R) [NTSR1; NTRR] - HUMAN |
| SEQ ID NO: 1347 | g35060 | Human mRNA for NKG2-C gene. |
| SEQ ID NO: 1348 | g35322 | *H. sapiens* mRNA for p cadherin. |
| SEQ ID NO: 1349 | g36060 | *H. sapiens* RING4 cDNA. |
| SEQ ID NO: 1350 | g36430 | 5-HYDROXYTRYPTAMINE 2A (5-HT-2A) [HTR2A; HTR2] - HUMAN |
| SEQ ID NO: 1351 | g36651 | *H. sapiens* RNA for syndecan. |
| SEQ ID NO: 1352 | g37432 | Human mRNA for transferrin receptor. |
| SEQ ID NO: 1353 | g37503 | Human tyk2 mRNA for non-receptor protein tyrosine kinase. |
| SEQ ID NO: 1354 | g37642 | *H. sapiens* mRNA for subunit C of vacuolar proton-ATPase V1 domain. |
| SEQ ID NO: 1355 | g38014 | Human mRNA for zinc finger protein 4 (clone). |
| SEQ ID NO: 1356 | g396704 | *H. sapiens* integrin associated protein mRNA, complete CDS,. |
| SEQ ID NO: 1357 | g400451 | ADENOSINE A2A [ADORA2A] - HUMAN |
| SEQ ID NO: 1358 | g405081 | GLUCAGON-LIKE PEPTIDE 1 (GLP-1-R) [GLP1R] - HUMAN |
| SEQ ID NO: 1359 | g407806 | CANNABINOID 2 (CB2) (CX5) [CNR2] - HUMAN |
| SEQ ID NO: 1360 | g408691 | CORTICOTROPIN RELEASING FACTOR 1 (CRF1) [CRHR; CRFR] - HUMAN |

TABLE 1-continued

| SEQ ID NO: | ID | Description |
|---|---|---|
| SEQ ID NO: 1361 | g410208 | PROSTAGLANDIN E2, EP1 SUBTYPE (PROSTANOID EP1) [PTGER1] - HUMAN |
| SEQ ID NO: 1362 | g413865 | 5-HYDROXYTRYPTAMINE 7 (5-HT-7) (5-HT-X) [HTR7] - HUMAN |
| SEQ ID NO: 1363 | g425220 | OLFACTORY RECEPTOR-LIKE PROTEIN HGMP07E (OR17-4) [OLFR1] - HUMAN |
| SEQ ID NO: 1364 | g425267 | Human Duffy blood group antigen (Fya-b+) mRNA, complete cds |
| SEQ ID NO: 1365 | g425351 | PROBABLE G PROTEIN-COUPLED RECEPTOR APJ [AGTRL1; APJ] - HUMAN |
| SEQ ID NO: 1366 | g431094 | SOMATOSTATIN TYPE 5 (SS5R) [SSTR5] - HUMAN |
| SEQ ID NO: 1367 | g432653 | Human mRNA for p62 nucleoporin. |
| SEQ ID NO: 1368 | g433200 | ALPHA-1C ADRENERGIC [ADRA1C] - HUMAN |
| SEQ ID NO: 1369 | g434699 | Human nitric oxide synthase mRNA |
| SEQ ID NO: 1370 | g438372 | *H. sapiens* mRNA for protein kinase C mu. |
| SEQ ID NO: 1371 | g438393 | OLFACTORY RECEPTOR-LIKE PROTEIN OR17-24 (FRAGMENT) - HUMAN |
| SEQ ID NO: 1372 | g438395 | OLFACTORY RECEPTOR-LIKE PROTEIN OR17-30 (FRAGMENT) - HUMAN |
| SEQ ID NO: 1373 | g438404 | OLFACTORY RECEPTOR-LIKE PROTEIN OR17-93 (FRAGMENT) - HUMAN |
| SEQ ID NO: 1374 | g438410 | OLFACTORY RECEPTOR-LIKE PROTEIN OR17-209 (FRAGMENT) - HUMAN |
| SEQ ID NO: 1375 | g438412 | OLFACTORY RECEPTOR-LIKE PROTEIN OR17-210 (FRAGMENT) - HUMAN |
| SEQ ID NO: 1376 | g438416 | OLFACTORY RECEPTOR-LIKE PROTEIN OR17-229 (FRAGMENT) - HUMAN |
| SEQ ID NO: 1377 | g439689 | GLUCAGON (GL-R) [GCGR] - HUMAN |
| SEQ ID NO: 1378 | g441149 | *Homo sapiens* tissue factor pathway inhibitor-2 mRNA, complete cds. |
| SEQ ID NO: 1379 | g452072 | MU-TYPE OPIOID (MOR-1) [OPRM1; MOR1] - HUMAN |
| SEQ ID NO: 1380 | g452495 | PROSTAGLANDIN E2, EP4 SUBTYPE (PROSTANOID EP4) [PTGER2] - HUMAN |
| SEQ ID NO: 1381 | g452756 | *H. sapiens* mRNA for TRAP beta subunit. |
| SEQ ID NO: 1382 | g456426 | Human (clone PSK-J3) cyclin-dependent protein kinase mRNA, complete cds. |
| SEQ ID NO: 1383 | g456563 | PROSTAGLANDIN F2 ALPHA (PROSTANOID FP) [PTGFR] - HUMAN |
| SEQ ID NO: 1384 | g457562 | PITUITARY ADENYLATE CYCLASE ACTIVATING POLYPEPTIDE TYPE I [ADCYAP1R1] - HUMAN |
| SEQ ID NO: 1385 | g460081 | Human monocyte LPS receptor CD14 gene, p |
| SEQ ID NO: 1386 | g460902 | ZNF75 = KRAB zinc finger [human, lung fibroblast, 15 mRNA, nt]. |
| SEQ ID NO: 1387 | g463549 | Human clone pSK1 interferon gamma receptor accessory factor-1 (AF-1) mRNA, complete cds. |
| SEQ ID NO: 1388 | g466488 | VASOPRESSIN V1A (VASCULAR/HEPATIC-TYPE ARGININE VASOPRESSIN) (AVPR V1A) [AVPR1A; AVPR1] - HUMAN |
| SEQ ID NO: 1389 | g468150 | Human MAP kinase mRNA |
| SEQ ID NO: 1390 | g468707 | *H. sapiens* OZF mRNA. |
| SEQ ID NO: 1391 | g471316 | PROBABLE OPIOID RECEPTOR (KAPPA-TYPE 3 OPIOID) (KOR-3) [ORL1] - HUMAN |
| SEQ ID NO: 1392 | g472555 | C-C CHEMOKINE RECEPTOR TYPE 2 (C-C CKR-2) (MCP-1-R) [CMKBR2] - HUMAN |
| SEQ ID NO: 1393 | g475197 | 5-HYDROXYTRYPTAMINE 2B (5-HT-2B) [HTR2B] - HUMAN |
| SEQ ID NO: 1394 | g487338 | excitatory amino acid transporter1 [Homo |
| SEQ ID NO: 1395 | g487340 | excitatory amino acid transporter2 [Homo |
| SEQ ID NO: 1396 | g487342 | excitatory amino acid transporter3 [Homo |
| SEQ ID NO: 1397 | g487427 | Human calcium-activated potassium channel mRNA, partial cds. |
| SEQ ID NO: 1398 | g487782 | Human zinc finger protein ZNF133. |
| SEQ ID NO: 1399 | g487837 | *Homo sapiens* zinc finger protein mRNA, 3' end. |
| SEQ ID NO: 1400 | g487839 | *Homo sapiens* zinc finger protein mRNA, 3' end. |
| SEQ ID NO: 1401 | g488550 | Human zinc finger protein ZNF132 mRNA, complete CDs. |
| SEQ ID NO: 1402 | g494982 | ALPHA-1B ADRENERGIC [ADRA1B] - HUMAN |
| SEQ ID NO: 1403 | g495042 | PROSTACYCLIN (PROSTANOID IP) [PTGIR; PRIPR] - HUMAN |
| SEQ ID NO: 1404 | g495472 | Human tyrosine kinase (HTK) mRNA, comple |
| SEQ ID NO: 1405 | g497313 | DELTA-TYPE OPIOID (DOR-1) [OPRD1; OPRD] - HUMAN |
| SEQ ID NO: 1406 | g498718 | *H. sapiens* HZF1 mRNA for zinc finger protein. |
| SEQ ID NO: 1407 | g498724 | *H. sapiens* HZF3 mRNA for zinc finger protein. |
| SEQ ID NO: 1408 | g505664 | Human cellular proto-oncogene (c-mer) mRNA, complete cds. |
| SEQ ID NO: 1409 | g507150 | Human IL12 receptor component mRNA, complete cds. |
| SEQ ID NO: 1410 | g507826 | Human glutamate receptor flip isoform (GluR3-flip) mRNA, complete cds. |
| SEQ ID NO: 1411 | g510295 | HISTAMINE H1 [HRH1] - HUMAN |
| SEQ ID NO: 1412 | g516262 | *H. sapiens* mRNA for adenylyl cyclase. |
| SEQ ID NO: 1413 | g516319 | OLFACTORY RECEPTOR-LIKE PROTEIN OR17-40 - HUMAN |
| SEQ ID NO: 1414 | g529236 | Human protein kinase mRNA, complete cds. |
| SEQ ID NO: 1415 | g530089 | Human MAP kinase activated protein kinas |

TABLE 1-continued

| | | |
|---|---|---|
| SEQ ID NO: 1416 | g531102 | prolactin |
| SEQ ID NO: 1417 | g532059 | KAPPA-TYPE OPIOID (KOR-1) [OPKR1; OPKR] - HUMAN |
| SEQ ID NO: 1418 | g533212 | macrophage inflammatory protein-1beta |
| SEQ ID NO: 1419 | g533325 | THROMBOXANE A2 (TXA2-R) [TBXA2R] - HUMAN |
| SEQ ID NO: 1420 | g536775 | Human gene for early lymphocyte activati |
| SEQ ID NO: 1421 | g545303 | PROSTAGLANDIN E2, EP3 SUBTYPE (PROSTANOID EP3) [PTGER3] - HUMAN |
| SEQ ID NO: 1422 | g550059 | Homo sapiens GTP-binding protein (RAB1) mRNA, complete cds. |
| SEQ ID NO: 1423 | g559047 | GALANIN [GALNR] - HUMAN |
| SEQ ID NO: 1424 | g560152 | Human mRNA for acetylcholine receptor (e |
| SEQ ID NO: 1425 | g563981 | VASOPRESSIN V1B (AVPR V1B) (VASOPRESSIN V3) (AVPR V3) [AVPR1B] - HUMAN |
| SEQ ID NO: 1426 | g577412 | PROBABLE G PROTEIN-COUPLED RECEPTOR GPR1 [GPR1] - HUMAN |
| SEQ ID NO: 1427 | g577414 | PROBABLE G PROTEIN-COUPLED RECEPTOR GPR2 [GPR2] - HUMAN |
| SEQ ID NO: 1428 | g577631 | THYROTROPIN-RELEASING HORMONE (TRH-R) [TRHR] - HUMAN |
| SEQ ID NO: 1429 | g598152 | PROBABLE G PROTEIN-COUPLED RECEPTOR GPR4 (GPR19) [GPR4; GPR19] - HUMAN |
| SEQ ID NO: 1430 | g598154 | PROBABLE G PROTEIN-COUPLED RECEPTOR GPR5 [GPR5] - HUMAN |
| SEQ ID NO: 1431 | g598156 | PROBABLE G PROTEIN-COUPLED RECEPTOR GPR6 [GPR6] - HUMAN |
| SEQ ID NO: 1432 | g599819 | EXTRACELLULAR CALCIUM-SENSING RECEPTOR [CASR; PCAR1] - HUMAN |
| SEQ ID NO: 1433 | g599826 | H. sapiens mRNA for serine/threonine protein kinase. |
| SEQ ID NO: 1434 | g599833 | Human VE-cadherin mRNA. |
| SEQ ID NO: 1435 | g602129 | ADRENOCORTICOTROPIC HORMONE (ACTH-R) (MC2-R) [MC2R; ACTHR] - HUMAN |
| SEQ ID NO: 1436 | g604499 | PROBABLE G PROTEIN-COUPLED RECEPTOR GPR12 [GPR12] - HUMAN |
| SEQ ID NO: 1437 | g607785 | Human protein kinase (JNK2) mRNA, complete cds. |
| SEQ ID NO: 1438 | g624627 | Human Fas ligand mRNA, complete cds. |
| SEQ ID NO: 1439 | g632971 | Homo sapiens clk3 mRNA, complete cds. |
| SEQ ID NO: 1440 | g632973 | Human cytokine receptor (EBI3) mRNA, complete cds. |
| SEQ ID NO: 1441 | g639719 | PROSTAGLANDIN E2, EP2 SUBTYPE (PROSTANOID EP2) - HUMAN |
| SEQ ID NO: 1442 | g665580 | PROBABLE G PROTEIN-COUPLED RECEPTOR V28 - HUMAN |
| SEQ ID NO: 1443 | g681913 | Human mRNA for serotonin 5-HT3 receptor, complete cds. |
| SEQ ID NO: 1444 | g685173 | Human MAP kinase kinase 3 (MKK3) mRNA |
| SEQ ID NO: 1445 | g685175 | Human MAP kinase kinase 4 (MKK4) |
| SEQ ID NO: 1446 | g693907 | SOMATOSTATIN TYPE 4 (SS4R) [SSTR4] - HUMAN |
| SEQ ID NO: 1447 | g712836 | VASOACTIVE INTESTINAL POLYPEPTIDE 2 (VIP-R-2) (PACAP-R-3) [VIPR2] - HUMAN |
| SEQ ID NO: 1448 | g726512 | Human nuclear orphan receptor LXR-alpha mRNA, complete cds. |
| SEQ ID NO: 1449 | g727358 | B1 BRADYKININ (BK-1R) [BDKRB1] - HUMAN |
| SEQ ID NO: 1450 | g736236 | CANNABINOID 1 (CB1) (CB-R) [CNR1; CNR] - HUMAN |
| SEQ ID NO: 1451 | g763533 | secretin receptor |
| SEQ ID NO: 1452 | g775207 | Human T-lymphocyte specific protein tyrosine kinase p56lck (lck) aberrant mRNA, complete cds. |
| SEQ ID NO: 1453 | g784993 | Human mRNA for EMR1 hormone receptor. |
| SEQ ID NO: 1454 | g790789 | Homo sapiens cam kinase I mRNA, complete cds. |
| SEQ ID NO: 1455 | g791046 | H. sapiens mRNA for gamma subunit of sodium potassium ATPase. |
| SEQ ID NO: 1456 | g798835 | P2Y PURINOCEPTOR 1 (ATP RECEPTOR) (P2Y1) [P2RY1] - HUMAN |
| SEQ ID NO: 1457 | g829176 | Human guanylate binding protein isoform II (GBP-2) mRNA, complete cds. |
| SEQ ID NO: 1458 | g837260 | Human ERK5 mRNA, complete cds. |
| SEQ ID NO: 1459 | g840770 | LEUCOCYTE ANTIGEN CD97 [CD97] - HUMAN |
| SEQ ID NO: 1460 | g841307 | Human transcriptional activation factor TAFII32 mRNA, complete cds. |
| SEQ ID NO: 1461 | g852056 | Homo sapiens casein kinase I epsilon mRNA, complete cds. |
| SEQ ID NO: 1462 | g871884 | Human apM2 mRNA for GS2374 (unknown product specific to adipose tissue), complete cds. |
| SEQ ID NO: 1463 | g887966 | PARATHYROID HORMONE (PTH2) [PTHR2] - HUMAN |
| SEQ ID NO: 1464 | g894158 | Human protein-tyrosine phosphatase (HU-PP-1) mRNA, partial sequence. |
| SEQ ID NO: 1465 | g899476 | alpha2i-subunit of guanylyl cyclase |
| SEQ ID NO: 1466 | g902001 | Human lymphotactin precursor mRNA, complete cds. |
| SEQ ID NO: 1467 | g902329 | TPCR26 protein |
| SEQ ID NO: 1468 | g903745 | LUTROPIN-CHORIOGONADOTROPIC HORMONE (LH/CG-R) (LSH-R) [LHCGR; LHRHR] - HUMAN |
| SEQ ID NO: 1469 | g903759 | THYROTROPIN (TSH-R) [TSHR] - HUMAN |

TABLE 1-continued

| | | |
|---|---|---|
| SEQ ID NO: 1470 | g905392 | Human GABAA receptor subunit alpha4 mRNA, complete cds. |
| SEQ ID NO: 1471 | g914099 | protein kinase PRK2 [human, DX3 B-cell myeloma cell line, 32 mRNA, nt] |
| SEQ ID NO: 1472 | g930336 | excitatory amino acid transporter4[Homo |
| SEQ ID NO: 1473 | g939924 | MELANOCORTIN-5 (MC5-R) (MC-2) [MC5R] - HUMAN |
| SEQ ID NO: 1474 | g940378 | PROSTAGLANDIN D2 (PROSTANOID DP) [PTGDR] (FRAGMENT) - HUMAN |
| SEQ ID NO: 1475 | g945096 | + METABOTROPIC GLUTAMATE 1 [GRM1; MGLUR1] - HUMAN |
| SEQ ID NO: 1476 | g951234 | H. sapiens Bmx mRNA for cytoplasmic tyrosine kinase. |
| SEQ ID NO: 1477 | g951318 | Human retinal nitric oxide synthase (NOS |
| SEQ ID NO: 1478 | g951320 | Human inducible nitric oxide synthase |
| SEQ ID NO: 1479 | g953232 | PROBABLE G PROTEIN-COUPLED RECEPTOR GPR7 [GPR7] - HUMAN |
| SEQ ID NO: 1480 | g953234 | PROBABLE G PROTEIN-COUPLED RECEPTOR GPR8 [GPR8] - HUMAN |
| SEQ ID NO: 1481 | g971193 | MELATONIN TYPE 1B (MEL-1B-R) [MTNR1B] - HUMAN |
| SEQ ID NO: 1482 | g984506 | P2U PURINOCEPTOR 1 (ATP RECEPTOR) (P2U1) [P2RY2; P2RU1] - HUMAN |
| SEQ ID NO: 1483 | g988304 | Human protein tyrosine kinase PYK2 mRNA, complete cds. |
| SEQ ID NO: 1484 | g992699 | putative G-protein-coupled receptor |
| SEQ ID NO: 1485 | g994730 | Homo sapiens tissue inhibitor of metalloproteinase 1 (TIMP1) gene, exon 2', 5' end of cds. |
| SEQ ID NO: 1486 | g995656 | IL-15 |
| SEQ ID NO: 1487 | g995918 | Human G protein gamma-10 subunit mRNA, complete cds. |
| SEQ ID NO: 1488 | g995934 | Human zinc-finger DNA binding protein (MAZ) mRNA, partial cds. |
| SEQ ID NO: 1489 | g998769 | voltage-gated chloride channel [human, placenta, 34 Genomic/mRNA, nt]. |
| SEQ ID NO: 1490 | g999415 | + METABOTROPIC GLUTAMATE 2 [GRM2; MGLUR2] - HUMAN |

TABLE 2

DESCRIPTION OF cDNA LIBRARIES

ADENINB01 Library was constructed using RNA isolated from the inflamed adenoid tissue of a 3-year-old child. (RNA came from Clontech.) cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector.

ADRENOT01 Library was constructed using RNA isolated from the normal adrenal glands of 5 male and female Caucasian donors, 10 to 46 years old. (RNA came from Clontech.) cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

ADRENOT03 Library was constructed using 2 micrograms of polyA RNA isolated from the adrenal tissue of a 17-year-old Caucasian male, who died from cerebral anoxia. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

ADRENOT07 Library was constructed using 1 microgram of polyA RNA isolated from adrenal tissue removed from a 61-year-old female during a bilateral adrenalectomy. Pathology indicated no significant abnormality of the right and left adrenal glands. Patient history included an unspecified disorder of the adrenal glands, depressive disorder, benign hypertension, vocal cord paralysis, hemiplegia, subarachnoid hemorrhage, communicating hydrocephalus, neoplasm of uncertain behavior of pituitary gland, hyperlipidemia, Type II diabetes, a benign neoplasm of the colon, osteoarthritis, Meckel's diverticulum, and tobacco use. Previous surgeries included total excision of the pituitary gland and a unilateral thyroid lobectomy. Patient medications included Calderol, calcium, hismal, nasal decongestants, and Premarin (conjugated estrogen). Family history included prostate cancer, benign hypertension, myocaridal infarction, atherosclerotic coronary artery disease, congestive heart failure, hyperlipidemia, depression, and anxiety disorder in the father; colon cancer, benign hypertension, depression, and anxiety disorder in the mother; gas gangrene in a sibling; and myocardial infarction and atherosclerotic coronary artery disease in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

AMLBNOT01 Library was constructed using RNA isolated from white blood cells collected from the peripheral blood of a 58-year-old Caucasian female who had acute myelogenous leukemia and was in a blast crisis. Patient medications included amoxicillin, cephalexin, premarin, and Suprax (cefixime). cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

BEPINOT01 Library was constructed using 1.1 micrograms of polyA RNA isolated from a bronchial epithelium (NHBE) primary cell line derived from a 54-year-old Caucasian male. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BLADNOT01 Library was constructed using 2 micrograms of polyA RNA isolated from the bladder tissue of a 78-year-old Caucasian female, who died from an intracranial bleed. Patient history included basal cell carcinoma, arthritis, chronic hypertension, and alcohol use. Previous surgeries included an appendectomy and hysterectomy. Patient medications included isosorbide, Bumex (bumetanide), atenolol, and clonidine. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

BLADNOT03 Library was constructed using 1 microgram of polyA RNA isolated from the nontumorous bladder tissue removed from an 80-year-old Caucasian female during a radical cystectomy and lymph node excision. Pathology for the associated tumor tissue indicated grade 3 invasive transitional cell carcinoma on the posterior wall of the bladder, with extension into the trigone. The tumor was deeply invasive, extending to perivisceral fat and to within 0.8 cm of the vaginal mucosal margin. Distal urethral margins, right and left ureters, and the left pelvic lymph node were negative for tumor. Patient history included malignant neoplasm of the uterus, benign hypertension, atherosclerosis, and atrial fibrillation. Previous surgeries included a bladder operation, total abdominal hysterectomy, removal of both ovaries, partial thyroidectomy, division of thyroid isthmus, aortocoronary bypass of three coronary arteries, and resection and replacement of abdominal aorta. Patient medications included Coumadin (crystalline warfarin sodium), Klotrix (potassium chloride), Lasix (furosemide), digoxin, and atenolol. The patient also previously received 4,500 rads of uterine radiation. Family history included acute renal failure and osteoarthritis in the mother, and atherosclerosis in the father and a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte)

BLADNOT04 Library was constructed using 1 microgram of polyA RNA isolated from bladder tissue of a 28-year-old Caucasian male, who died from a self-inflicted gunshot wound. The patient had a history of alcohol and tobacco use (1–2 packs of cigarettes per day); otherwise, the medical history and serologies were negative. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte). This library contains markers for seminal vesicle tissue, indicating that it is a heterogeneous mixture of both bladder and seminal vesicle tissue.

BLADNOT06 Library was constructed using 1 microgram of polyA RNA isolated from the posterior wall bladder tissue removed from a 66-year-old Caucasian male during a radical prostatectomy, radical cystectomy, and urinary diversion. Pathology for the associated tumor tissue indicated grade 3 transitional cell carcinoma on the anterior wall of the bladder and urothelium. This was also associated with a grade 3 transitional cell carcinoma of the prostate and prostatic urethra, with diffuse invasion to the prostatic parenchyma anteriorly and posteriorly. In addition, the right prostate contained a microscopic adenocarcinoma (Gleason grade 3+2), which was confined to the prostate and showed no capsular penetration. Surgical margins and multiple pelvic lymph nodes were negative for tumor. The patient presented with prostatic inflammatory disease. Patient history included lung neoplasm, benign hypertension, and tobacco abuse in remission. Previous surgeries included a transurethral prostatectomy. Patient medications included iron supplements and Dyazide. Family history included a malignant breast neoplasm in the mother; tuberculosis in the father; and benign hypertension, cerebrovascular disease, atherosclerotic coronary artery disease and lung cancer in the sibling(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BLADTUT02 Library was constructed using 1 microgram of polyA RNA isolated from bladder tumor tissue removed from an 80-year-old Caucasian female during a radical cystectomy and lymph node excision. Pathology indicated grade 3 invasive transitional cell carcinoma, forming a 3×2.5×1 cm mass on the posterior wall of the bladder, with extension into the trigone. The tumor was deeply invasive, extending to perivisceral fat and to within 0.8 cm of the vaginal mucosal margin. Distal urethral margins, right and left ureters, and the left pelvic lymph node were negative for tumor. Patient history included malignant neoplasm of the uterus, benign hypertension, atherosclerosis, and atrial fibrillation. Previous surgeries included a bladder operation, total abdominal hysterectomy, removal of both ovaries, partial thyroidectomy, division of thyroid isthmus, aortocoronary bypass of three coronary arteries, and resection and replacement of abdominal aorta. Patient medications included Coumadin (crystalline warfarin sodium), Klotrix (potassium chloride), Lasix (furosemide), digoxin, and atenolol. The patient also previously received 4,500 rads of uterine radiation. Family history included acute renal failure and osteoarthritis in the mother, and atherosclerosis in the father and a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BLADTUT04 Library was constructed using 0.81 micrograms of polyA RNA isolated from bladder tumor tissue removed from a 60-year-old Caucasian male during a radical cystectomy, prostatectomy, and vasectomy. Pathology indicated grade 3 transitional cell carcinoma in the left bladder wall, with extension through the muscularis propria into the perivascular fat. Carcinoma in-situ was identified in the dome and trigone. The distal urethral margin was negative for tumor, but the prostate showed adenofibromatous hyperplasia. Both ureters were negative for tumor. The patient presented with dysuria. Patient history included tobacco use. Patient medications included vitamins C and E, cloves, wormwood, black walnut hull, beta carotene, garlic, and pycnodgeneal. Family history included Type I diabetes in the mother and father, a malignant neoplasm of the stomach in the father, and atherosclerotic coronary artery disease and an acute myocardial infarction in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BLADTUT05 Library was constructed using 1 microgram of polyA RNA isolated from bladder tumor tissue removed from a 66-year-old Caucasian male during a radical prostatectomy, radical cystectomy, and urinary diversion. Pathology indicated grade 3 transitional cell carcinoma on the anterior wall of the bladder, with an adjacent focal transitional cell carcinoma in-situ involving the urothelium. This was also associated with a grade 3 transitional cell carcinoma of the prostate and prostatic urethra, with diffuse invasion to the prostatic parenchyma anteriorly and posteriorly. In addition, the right prostate contained a microscopic adenocarcinoma (Gleason grade 3+2), which was confined to the prostate and showed no capsular penetration. Surgical margins and multiple pelvic lymph nodes were negative for tumor. The patient presented with prostatic inflammatory disease. Patient history included lung neoplasm, benign hypertension, and tobacco abuse in remission. Previous surgeries included a transurethral prostatectomy. Patient medications included iron supplements and Dyazide. Family history included a malignant breast neoplasm in the mother; tuberculosis in the father; and benign hypertension, cerebrovascular disease, atherosclerotic coronary artery disease and lung cancer in the sibling(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BLADTUT07 Library was constructed using 1 microgram of polyA RNA isolated from bladder tumor tissue removed from the anterior bladder wall of a 58-year-old Caucasian male during a radical cystectomy, radical prostatectomy, and gastrostomy. Pathology indicated marked cystitis with scattered microscopic foci of transitional cell carcinoma in situ. This tumorous tissue was associated with a grade 3 transitional cell carcinoma, which formed an ulcerated infiltrative mass in the left lateral bladder wall. The tumor extended through the muscularis into the perivesical fat, but did not involve the serosal surface. Surgical margins and lymph nodes were negative for tumor; the prostate showed adenofibromatous hyperplasia. Patient history included angina, emphysema, and alcohol and tobacco use. Family history included acute myocardial infarction, atherosclerotic coronary artery disease, and Type II diabetes in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BMARNOR02 Library was constructed using RNA isolated from the normal bone marrow of 24 male and female Caucasian donors, 16 to 70 years old. (RNA came from Clontech.) cDNA synthesis was initiated using a random primer. Double-stranded cDNA was blunted, ligated to EcoRI adaptors, digested with XhoI, size-selected, and cloned into the XhoI and EcoRI sites of the Lambda UniZAP vector.

BMARNOT02 Library was constructed using RNA isolated from the normal bone marrow of 24 male and female Caucasian donors, 16 to 70 years old. (RNA came from Clontech.) cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. The same RNA source was used to make BMARNOR02, which was random-primed.

BONRTUT01 Library was constructed using 7.5 nanograms of polyA RNA isolated from rib tumor tissue removed from a 16-year-old Caucasian male during a rib osteotomy and a wedge resection of the lung. Pathology indicated a metastatic grade 3 (of 4) osteosarcoma, forming a mass involving the chest wall. The parietal pleura was intact. Tissue from the left lower lobe of the lung and left lingula showed caseating granuloma. Tissue from the left upper lobe of the lung was scarred. A silver stain for fungi was negative. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BONTNOT01 Library was constructed using 7 nanograms of polyA RNA isolated from nontumorous tibial periosteum removed from a 20-year-old Caucasian male during a hemipelvectomy with amputation above the knee. There was no pathology for the periosteum. Pathology for the associated tumor tissue indicated partially necrotic and cystic osteoblastic grade 3 osteosarcoma (post-chemotherapy). The tumor involved almost the entire length of the femoral shaft along the site of a previously placed metal rod tract. The patient presented with a bone infection. Patient history included osteogenesis imperfecta, pathologic-closed fracture, non-union of a fracture, and tobacco use. Previous surgeries included another above-the-knee amputation. Patient medications included Ifosfamide, Mensa, Leukovorin, Adriamycin, Methotrexater, Cisplatin, Zinecard, MS CONTIN, Advil, calcium citrate, vitamin D, and laxatives. Family history included osteogenesis imperfecta and closed fracture in the mother; osteogenesis imperfecta and closed fracture in the sibling(s), and osteogenesis imperfecta, closed fracture, and Type II diabetes in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAINON01 This normalized brain library was constructed from 4.88 million independent clones from the BRAINOT03 library. Starting RNA was made from nontumorous brain tissue removed from a 26-year-old Caucasian male during cranioplasty and excision of a cerebral meningeal lesion. Pathology for the associated tumor tissue indicated a grade 4 oligoastrocytoma in the right fronto-parietal part of the brain. The patient presented with epilepsy, ptosis of the eyelid, hemiplegia and migraine. Patient history included radiation therapy, hypercholesterolemia, and a clavicle fracture. Previous surgeries included insertion of a steriotactic frame. Patient medications included Dilantin (phenytoin). The library was oligo(dT)-primed, and cDNAs were cloned directionally into the pSPORT1 vectoring system using Sal1 (5') and Not1 (3'). The normalization and hybridization conditions were adapted from Soares et al., *PNAS* (1994) 91: 9928, except that a significantly longer (48-hour) reannealing hybridization was used.

BRAINOT03 Library was constructed using 3 micrograms of polyA RNA isolated from nontumorous brain tissue removed from a 26-year-old Caucasian male during carnioplasty and excision of a cerebral meningeal lesion. Pathology for the associated tumor tissue indicated a grade 4 oligoastrocytoma in the right fronto-parietal part of the brain. The patient presented with epilepsy, ptosis of the eyelid, hemiplegia and migraine. Patient history included radiation therapy, hypercholesterolemia, and a clavicle fracture. Previous surgeries included insertion of a steriotactic frame. Patient medications included Dilantin (phenytoin). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRAINOT04 Library was constructed using 1 microgram of polyA RNA isolated from the brain tissue of a 44-year-old Caucasian male with a cerebral hemorrhage. The tissue, which contained coagulated blood, came from the choroid plexus of the right anterior temporal lobe. Patient history included alcohol and tobacco use. Patient medications included Dilantin (phenytoin). Family history included coronary artery disease and myocardial infarction in the father.

cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRAINOT09 Library was constructed using 1 microgram of polyA RNA isolated from nontumorous brain tissue removed from a Caucasian male fetus, who died at 23 weeks' gestation from premature birth. Serology was negative. Family history included diabetes in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAINOT10 Library was constructed using 1 microgram of polyA RNA isolated from diseased cerebellum tissue removed from the brain of a 74-year-old Caucasian male, who died from Alzheimer's disease. Serologies were negative. Patient history included sacral decubitus (bedsores). Previous surgeries included prostate surgery. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAINOT11 Library was constructed using 1 microgram of polyA RNA isolated from brain tissue removed from the right temporal lobe of a 5-year-old Caucasian male during a hemispherectomy. Pathology indicated extensive polymicrogyria and mild to moderate gliosis (predominantly subpial and subcortical), which are consistent with chronic seizure disorder. The patient presented with intractable convulsive epilepsy. Prior to surgery, he was prescribed Dilantin (phenytoin) and Depakote (divalproex sodium) as part of epilepsy therapy. Previous surgeries included repair of indirect inguinal hernia. Family history included a cervical neoplasm in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAINOT12 Library was constructed using 1 microgram of polyA RNA isolated from brain tissue removed from the right frontal lobe of a 5-year-old Caucasian male during a hemispherectomy. Pathology indicated extensive polymicrogyria and mild to moderate gliosis (predominantly subpial and subcortical), which are consistent with chronic seizure disorder. The patient presented with intractable convulsive epilepsy. Prior to surgery, he was prescribed Dilantin (phenytoin) and Depakote (divalproex sodium) as part of epilepsy therapy. Previous surgeries included repair of indirect inguinal hernia. Family history included a cervical neoplasm in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAINOT14 Library was constructed using 1 microgram of polyA RNA isolated from brain tissue removed from the left frontal lobe of a 40-year-old Caucasian female during excision of a cerebral meningeal lesion. Pathology for the associated tumor tissue indicated grade 4 gemistocytic astrocytoma. The patient presented with coma, epilepsy, incontinence of urine and stool, Type II diabetes, and paralysis. Patient history included chronic nephritis and cesarean delivery. Patient medications included Decadron (dexamethasone) and phenytoin sodium. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAITUT01 Library was constructed using 1 microgram of polyA RNA isolated from brain tumor tissue removed from a 50-year-old Caucasian female during a frontal lobectomy. Pathology indicated recurrent grade 3 oligoastrocytoma with focal necrosis and extensive calcification. Patient history included a speech disturbance and epilepsy. Patient medications included Tegretol (carbamazepine) as part of epilepsy therapy. The patient's brain had also been irradiated with a total dose of 5,082 cyg (Fraction 8). Family history included a brain tumor in a maternal uncle. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRAITUT02 Library was constructed using 1 microgram of polyA RNA isolated from brain tumor tissue removed from the frontal lobe of a 58-year-old Caucasian male during excision of a cerebral meningeal lesion. Pathology indicated a grade 2 metastatic hypernephroma. The patient presented with migraine headache. The patient developed a cerebral hemorrhage and pulmonary edema, and died during this hospitalization. Patient history included a grade 2 renal cell carcinoma, insomnia, and chronic airway obstruction. Previous surgeries included a nephroureterectomy. Patient medications included Decadron (dexamethasone) and Dilantin (phenytoin). Family history included a malignant neoplasm of the kidney in the father. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRAITUT03 Library was constructed using 1 microgram of polyA RNA isolated from brain tumor tissue removed from the left frontal lobe a17-year-old Caucasian female during excision of a cerebral meningeal lesion. Pathology indicated a grade 4 fibrillary giant and small-cell astrocytoma. The patient presented with a headache and papilledema associated with increased intracranial pressure. Patient history included benign hypertension. Patient medications included Decadron (dexamethasone). Family history included benign hypertension and cerebovascular disease in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRAITUT07 Library was constructed using 0.8 micrograms of polyA RNA isolated from brain tumor tissue removed from the left frontal lobe of a 32-year-old Caucasian male during excision of a cerebral meningeal lesion. Pathology indicated cerebral glioma of high-grade small-cell variant with metastases. The patient presented with nausea, vomiting, and headache. Patient history included arteriosclerotic coronary disease, alcohol and tobacco use, and marijuana use twice a week for six years. Family history included arteriosclerotic coronary disease in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAITUT08 Library was constructed using 1 microgram of polyA RNA isolated from brain tumor tissue removed from the left frontal lobe of a 47-year-old Caucasian male during excision of cerebral meningeal tissue. Pathology indicated grade 4 fibrillary astrocytoma with focal tumoral radionecrosis. The patient presented with paralysis and convulsive, intractable epilepsy. Patient history included cerebrovascular disease, deficiency anemia, hyperlipidemia, epilepsy, and tobacco use. Previous surgeries included tonsillectomy with adenoidectomy, repair of indirect inguinal hernia, and total arthroplasty in both knees. Patient medications included Tegretol (carbamazepine), Dilantin (phenytoin), dexamethasone, and multivitamins. Family history included cerebrovascular disease in a grandparent and a malignant prostate neoplasm in the father. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAITUT12 Library was constructed using 1 microgram of polyA RNA isolated from brain tumor tissue removed from the left frontal lobe of a 40-year-old Caucasian female during excision of a cerebral meningeal lesion. Pathology indicated grade 4 gemistocytic astrocytoma. The patient presented with coma, epilepsy, and incontinence of urine and stool, Type II diabetes, and paralysis. Patient history included chronic nephritis and cesarean delivery. Patient medications included Decadron (dexamethasone) and phenytoin sodium. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAITUT13 Library was constructed using 1 microgram of polyA RNA isolated from brain tumor tissue removed from the left frontal lobe of a 68-year-old Caucasian male during excision of a cerebral meningeal lesion. Pathology indicated a meningioma in the left frontal lobe. The patient presented with depressive disorder, atrial fibrillation, and gait abnormality. Patient history included mitral stenosis with insufficiency and a tissue-graft replacement of an aortic valve. Patient medications included Coumadin (crystalline warfarin sodium), Zantac (ranitidine), bethametasone, Lasix (furosemide), and amiodarone. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRAITUT22 Library was constructed using 0.5 micrograms of polyA RNA isolated from brain tumor tissue removed from the right frontal/parietal lobe of a 76-year-old Caucasian female during excision of a cerebral meningeal lesion. Pathology indicated a meningioma. The patient presented with nonintractable epilepsy and transient limb paralysis. Patient history included benign hypertension, glaucoma, ventral hernia, tobacco use, and a normal delivery. Previous surgeries included an appendectomy, a total abdominal hysterectomy, a cholecystectomy, an intracapsular extraction of the lens, a hernia repair, and an open reduction of a fracture. The patient was not taking any medications. Family history included senile dementia in the father. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRSTNOT01 Library was constructed using 5 micrograms of polyA RNA isolated from the breast tissue of a 56-year-old Caucasian female, who died in a motor vehicle accident. cDNA synthesis was initiated using an XhoI-oligo (dT) primer. Double-stranded cDNA was blunted, ligated to EcoRI adaptors, digested with XhoI, size-selected, and cloned into the XhoI and EcoRI sites of the Lambda UniZAP vector.

BRSTNOT02 Library was constructed using 0.8 micrograms of polyA RNA isolated from nontumorous breast tissue removed from a 55-year-old Caucasian female during a unilateral extended simple mastectomy. Pathology indicated proliferative fibrocysytic changes characterized by apocrine metaplasia, sclerosing adenosis, cyst formation, and ductal hyperplasia without atypia. Pathology for the associated tumor tissue indicated an invasive grade 4 mammary adenocarcinoma of mixed lobular and ductal type, extensively involving all four quadrants of the left breast. The tumor was identified in the deep dermis near the lactiferous ducts with extracapsular extension. Surgical margins were negative. Seven mid and low and five high axillary lymph nodes were positive for tumor. Patient history included atrial tachycardia, blood in the stool, a benign breast neoplasm, and alcohol and tobacco use. Patient medications included Valium (diazepam) the week prior to surgery. Family history included benign hypertension and atherosclerotic coronary artery disease in the father; atherosclerotic coronary artery disease in the mother; cerebrovascular disease, depressive disorder and alcohol use in the sibling(s); and atherosclerotic coronary artery disease, alcohol use, and alcoholic liver damage in the grandparent (s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRSTNOT03 Library was constructed using 0.96 micrograms of polyA RNA isolated from nontumorous breast tissue removed from a 54-year-old Caucasian female during a bilateral radical mastectomy. Pathology for the associated tumor tissue indicated residual invasive grade 3 mammary ductal adenocarcinoma. The remaining breast parenchyma exhibited proliferative fibrocystic changes without atypia. The skin, nipple, and fascia were uninvolved. Fibroadipose tissue from the right breast was negative for tumor. One of 10 axillary lymph nodes had metastatic tumor, as a microscopic intranodal focus. Patient history included kidney infection and condyloma acuminatum. Previous surgeries included bilateral fallopian tube crushing and a vaginal hysterectomy. Patient medications included estrogen, Tylenol, Aleve, and multivitamins. Family history included benign hypertension in the father, benign hypertension and hyperlipidemia in the mother, and a malignant neoplasm of the colon in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRSTNOT04 Library was constructed using 0.5 micrograms of polyA RNA isolated from nontumorous breast tissue removed from a 62-year-old East Indian female during a unilateral extended simple mastectomy. Pathology for the associated tumor tissue indicated an invasive grade 3 ductal carcinoma. A 0.4 cm focus of carcinoma in situ was identified in the lower outer quadrant of the breast. Surgical margins were negative for tumor. Multiple mid and low axillary lymph nodes contained micrometastasis, and estrogen/progesterone receptors were positive. Patient history included benign hypertension, hyperlipidemia, and hematuria. Family history included cerebrovascular disease and atherosclerotic coronary artery disease in the father; and cerebrovascular disease, atherosclerotic coronary artery disease, hyperlipidemia, and liver cancer in the sibling(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRSTNOT05 Library was constructed using 0.44 micrograms of polyA RNA isolated from nontumorous breast tissue removed from a 58-year-old Caucasian female during a unilateral extended simple mastectomy. Pathology for the associated tumor tissue indicated multicentric invasive grade 4 lobular carcinoma. The mass was identified in the upper outer quadrant of the left breast. Three separate nodules were also found in the lower outer quadrant of the left breast. All surgical margins including the skin, nipple, and fascia were negative for tumor. No evidence of vascular invasion was found. All axillary lymph nodes were negative for tumor. Patient history included skin cancer, rheumatic heart disease, osteoarthritis, and tuberculosis. Previous surgeries included a unilateral simple mastectomy. Patient medications included tamoxifen to inhibit the induction of mammary carcinoma, Zantac (ranitidine hydrochloride), aspirin, Tylenol, and vitamin C. Family history included cerebrovascular disease and coronary artery aneurysm in the father; breast cancer in the mother; prostate cancer in the sibling(s); and cerebrovascular disease, atherosclerotic coronary artery disease, and Type I diabetes in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRSTNOT07 Library was constructed using 1 microgram of polyA RNA isolated from nontumorous breast tissue removed from a 43-year-old Caucasian female during unilateral extended simple mastectomy. Pathology indicated mildly proliferative fibrocystic changes with epithelial hyperplasia, papillomatosis, and duct ectasia. Pathology for the associated tumor tissue indicated invasive grade 4, nuclear grade 3 mammary adenocarcinoma with extensive comedo necrosis. Approximately 50 percent of the tumor was intraductal (comedo carcinoma). A microscopic focus of residual intraductal carcinoma was identified at the biopsy site in the lower inner quadrant of the right breast. The overlying skin, nipple, deep fascia, and axillary lymph nodes were negative for tumor. Previous surgeries included a normal delivery, a vaginal hysterectomy, and a cystocele repair. Patient medications included Triamterene/HTZ, vitamins A and B2, multivitamins, calcium, and Fibercon. Family history included atherosclerotic coronary artery disease and a coronary artery bypass grafting in the father; epilepsy in the mother, and Type II diabetes in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRSTNOT09 Library was constructed using 1 microgram of polyA RNA isolated from nontumor breast tissue removed from a 45-year-old Caucasian female during unilateral extended simple mastectomy. Pathology for the associated tumor tissue indicated invasive nuclear grade 2–3 adenocarcinoma in the same breast, with 3 of 23 lymph nodes positive for metastatic disease. There were also positive estrogen/progesterone receptors and uninvolved tissue showing proliferative changes. The surgical margins, including the skin, nipple, and fascia, were free of involvement. The patient concurrently underwent a total abdominal hysterectomy. Patient history included valvuloplasty of mitral valve without replacement, rheumatic mitral insufficiency, rheumatic heart disease, and tobacco use. Family history included acute myocardial infarction and atherosclerotic coronary artery disease in the father, and Type II diabetes in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BRSTTUT01 Library was constructed using 2 micrograms of polyA RNA isolated from breast tumor tissue removed from a 55-year-old Caucasian female during a unilateral extended simple mastectomy. Pathology indicated invasive grade 4 mammary adenocarcinoma of mixed lobular and ductal type, extensively involving all four quadrants of the left breast. The tumor was identified in the deep dermis near the lactiferous ducts with extracapsular extension. Surgical margins were negative. Seven mid and low and five high axillary lymph nodes were positive for tumor. Proliferative fibrocysytic changes were characterized by apocrine metaplasia, sclerosing adenosis, cyst formation, and ductal hyperplasia without atypia. Patient history included atrial tachycardia, blood in the stool, a benign breast neoplasm, and alcohol and tobacco use. Patient medications included Valium (diazepam) the week prior to surgery. Family history included benign hypertension and atherosclerotic coronary artery disease in the father; atherosclerotic coronary artery disease in the mother; cerebrovascular disease, depressive disorder and alcohol use in the sibling(s); and atherosclerotic coronary artery disease, alcohol use, and alcoholic liver damage in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRSTTUT02 Library was constructed using 0.8 micrograms of polyA RNA isolated from breast tumor tissue removed from a 54-year-old Caucasian female during a bilateral radical mastectomy with reconstruction. Pathology indicated residual invasive grade 3 mammary ductal adenocarcinoma. The remaining breast parenchyma exhibited proliferative fibrocystic changes without atypia. The skin, nipple, and fascia were uninvolved. Fibroadipose tissue from the right breast was negative for tumor. One of 10 axillary lymph nodes had metastatic tumor as a microscopic intranodal focus. Patient history included kidney infection and condyloma acuminatum (genital warts). Previous surgeries included bilateral fallopian tube crushing and a vaginal hysterectomy. Patient medications included estrogen, Tylenol, Aleve, and multivitamins. Family history included benign hypertension in the father, benign hypertension and hyperlipidemia in the mother, and a malignant neoplasm of the colon in the grandparent(s). cDNA synthesis was initiated using a NobtI-oligo(dT) primer. Double-stranded cDNA was blunted, ligated to SalI adaptors, digested with NotI, size-selected, and cloned into the NotI and SalI sites of the pSPORT1 vector BRSTTUT03 Library was constructed using 1 microgram of polyA RNA isolated from breast tumor tissue removed from a 58-year-old Caucasian female during a unilateral extended simple mastectomy. Pathology indicated multicentric invasive grade 4 lobular carcinoma. The mass was identified in the upper outer quadrant of the left breast. Three separate nodules were also found in the lower outer quadrant of the left breast. All surgical margins including the skin, nipple, and fascia were negative for tumor. No evidence of vascular invasion was found. All axillary lymph nodes were negative for tumor. Patient history included skin cancer, rheumatic heart disease, osteoarthritis, and tuberculosis. Previous surgeries included a unilateral simple mastectomy. Patient medications included tamoxifen to inhibit the induction of mammary carcinoma, Zantac (ranitidine hydrochloride), aspirin, Tylenol, and vitamin C. Family history included cerebrovascular disease and coronary artery aneurysm in the father; breast cancer in the mother; prostate cancer in the sibling(s); and cerebrovascular disease, atherosclerotic coronary artery disease, and Type I diabetes in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

BRSTTUT08 Library was constructed using 1 microgram of polyA RNA isolated from breast tumor tissue removed from a 45-year-old Caucasian female during unilateral extended simple mastectomy. Pathology indicated invasive nuclear grade 2–3 adenocarcinoma (ductal type), with 3 of 23 lymph nodes positive for metastatic disease. Greater than 50% of the tumor volume was in-situ, both comedo and non-comedo types. There were also positive estrogen/progesterone receptors and uninvolved tissue showing proliferative changes. The surgical margins, including the skin, nipple, and fascia, were free of involvement. The patient concurrently underwent a total abdominal hysterectomy. Patient history included valvuloplasty of mitral valve without replacement, rheumatic mitral insufficiency, rheumatic heart disease, and tobacco use. Family history included acute myocardial infarction and atherosclerotic coronary artery disease in the father, and Type II diabetes in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

BSTMNOT01 Library was constructed using 3 micrograms of polyA RNA isolated from the brain stem tissue of a 72-year-old Caucasian male, who died from a myocardial infaction. Patient history included coronary artery disease, diabetes mellitus, arthritis, and tobacco use. Previous surgeries included coronary artery bypass. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

CARDNOT01 Library was constructed using RNA isolated from the normal cardiac muscle of a 65-year-old Caucasian male, who died from a self-inflicted gunshot wound. Patient medications included phenobarbital. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

CERVNOT01 Library was constructed using 1 microgram of polyA RNA isolated from the cervical tissue of a 35-year-old Caucasian female during a vaginal hysterectomy with a dilation and curettage. Pathology indicated mild chronic cervicitis. The endometrium was secretory phase with a benign endometrial polyp 1 cm in diameter. The myometrium was unremarkable. The left ovary biopsy was negative for endometriosis. A portion of a hemorrhagic corpus luteum was present. The patient presented with abdominal pain. Patient history included hypothyroidism. Previous surgeries included adenotonsillectomy and cholecystectomy. Patient medications included Prozac (fluoxetine hydrochoride) and Synthroid (levothyroxine sodium). Family history included atherosclerotic coronary artery disease and Type II diabetes in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

COLNCRT01 Library was constructed using 0.99 micrograms of polyA RNA isolated from a diseased section of the ascending colon of a 40-year-old Caucasian male during a partial colectomy. Pathology indicated Crohn's disease involving the proximal colon and including the cecum. The ascending and transverse colon displayed linear ulcerations and skip lesions. There was transmural inflammation but no fistulas. The ileum was uninvolved. There was also a benign carcinoid tumor in the tip of the appendix. Patient history included anorexia nervosa, candidiasis of the mouth, Type I diabetes, diarrhea, viral meningitis, polyp of the vocal cord, and tobacco use. Previous surgeries included repair of an inguinal hernia. Patient medications included Zantac (ranitidine), Prednisone, Annusol suppositories, and insulin. Family history included hypertension in the mother. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

COLNFET02 Library was constructed using 1 microgram of polyA RNA isolated from the colon tissue of a Caucasian female fetus, who died at 20 weeks' gestation from fetal demise. Serology was negative. Family history included seven days of erythromycin treatment for bronchitis in the mother during the first trimester. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNNOT01 Library was constructed using 2 micrograms of polyA RNA isolated from nontumorous colon tissue removed from a 75-year-old Caucasian male during a hemicolectomy. Pathology for the associated tumor tissue indicated invasive grade 3 adenocarcinoma arising in a tubulovillous adenoma, which was distal to the ileocecal valve in the cecum. The tumor penetrated deeply into the muscularis propria but not through it. The patient presented with blood in his stool. Patient history included thrombophlebitis, chronic airway obstruction, atherosclerosis, cerebrovascular disease, and tobacco use. Previous surgeries included a cholecystectomy, appendectomy, and intracapsular extraction of the lens for phacolytic glaucoma. Patient medications included Betoptic (betaxol hydrocholoride) and pilocarpine hydrochloride for treatment of glaucoma, and Procardia (nifedipine). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

COLNNOT05 Library was constructed using 1.4 micrograms of polyA RNA isolated from the normal sigmoid colon tissue of a 40-year-old Caucasian male during a partial colectomy. Pathology indicated Crohn's disease involving the proximal colon and including the cecum. The ascending and transverse colon displayed linear ulcerations and skip lesions. There was transmural inflammation but no fistulas. The ileum was uninvolved. There was also a benign carcinoid tumor in the tip of the appendix. Patient history included anorexia nervosa, candidiasis of the mouth, Type I diabetes, diarrhea, viral meningitis, polyp of the vocal cord, and tobacco use. Previous surgeries included repair of an inguinal hernia. Patient medications included Zantac (ranitidine), Prednisone, Annusol suppositories, and insulin. Family history included hypertension in the mother. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

COLNNOT08 Library was constructed using 1 microgram of polyA RNA isolated from nontumorous colon tissue removed from a 60-year-old Caucasian male during a left hemicolectomy. Pathology for the associated tumor tissue indicated an invasive grade 2 adenocarcinoma, which extended through the submucosa superficially into the muscularis propria. The margins of resection were free of involvement. One of 9 regional lymph nodes contained metastatic adenocarcinoma. The patient presented with blood in the stool and a change in bowel habits. Patient history included thrombophlebitis, inflammatory polyarthropathy, prostatic inflammatory disease, and depressive disorder. Previous surgeries included resection of the rectum, a vasectomy, and exploration of the spinal canal. Patient medications included Seldane (terfenadin). Family history included atherosclerotic coronary artery disease in the mother and colon cancer in the sibling(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

COLNNOT11 Library was constructed using 1 microgram of polyA RNA isolated from nontumorous colon tissue removed from a 60-year-old Caucasian male during a left hemicolectomy. Pathology for the associated tumor tissue indicated an invasive grade 2 adenocarcinoma, which extended through the submucosa superficially into the muscularis propria. The margins of resection were free of involvement. One of 9 regional lymph nodes contained metastatic adenocarcinoma. The patient presented with blood in the stool and a change in bowel habits. Patient history included thrombophlebitis, inflammatory polyarthropathy, prostatic inflammatory disease, and depressive disorder. Previous surgeries included resection of the rectum, a vasectomy, and exploration of the spinal canal. Patient medications included Seldane (terfenadin). Family history included atherosclerotic coronary artery disease in the mother and colon cancer in the sibling(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

COLNNOT13 Library was constructed using 1 microgram of polyA RNA isolated from unaffected ascending colon tissue of a 28-year-old Caucasian male with moderate chronic ulcerative colitis. The patient presented with blood in the stool, diarrhea, and deficiency anemia. Patient history included acute myocardial infarction, shoulder dystonia (sprained rotator cuff), and tobacco use. Previous surgeries included a temporary ileostomy. Patient medications included Asacol (mesalamine) for colitis, Prednisone (glucocorticoid), and cortisone enemas. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNNOT16 Library was constructed using 1 microgram of polyA RNA isolated from nontumorous sigmoid colon tissue removed from a 62-year-old Caucasian male during a sigmoidectomy and permanent colostomy. Pathology for the associated tumor tissue indicated invasive grade 2 adenocarcinoma, with invasion through the muscularis. Surgical margins were negative for tumor. One lymph node contained metastasis with extranodal extension. The patient presented with blood in his stool. Patient history included hyperlipidemia, cataract disorder, and dermatitis. Previous surgeries included a cholecystectomy and repair of indirect inguinal hernia. Patient medications included multivitamins, vitamin C, and iron supplements. Family history included benign hypertension, atherosclerotic coronary artery disease, and hyperlipidemia in the father; breast cancer in the mother; and prostate cancer in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNNOT19 Library was constructed using 1 microgram of polyA RNA isolated from the unaffected cecal tissue of an 18-year-old Caucasian female with irritable bowel syndrome (IBS). The cecal tissue, along with the appendix and ileum tissue, were removed during bowel anastomosis. Pathology indicated Crohn's disease of the ileum, involving 15 cm of the small bowel. The cecum and appendix were unremarkable, and the margins were uninvolved. The patient presented with abdominal pain and regional enteritis. Patient history included osteoporosis of the vertebra and abnormal blood chemistry. Patient medications included Prilosec (omeprazole), Pentasa (mesalamine), amoxicillin, and multivitamins. Family history included cerebrovascular disease in the mother and a grandparent, and atherosclerotic coronary artery disease in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNNOT22 Library was constructed using 1 microgram of polyA RNA isolated from unaffected colon tissue removed from a 56-year-old Caucasian female with Crohn's disease during a partial resection of the small intestine. Pathology indicated Crohn's disease of the ileum and ilealcolonic anastomosis, causing a fistula at the anastomotic site that extended into pericolonic fat. The ileal mucosa showed linear and puncture ulcers with intervening normal tissue. The colon wall and mucosa were without diagnostic abnormality, and the surgical margins were free of involvement. The patient presented with bloody stool and obstruction. The patient had a history of obesity. Previous surgeries included a partial ileal resection, permanent ileostomy, cholecystectomy, and excision of breast lesions. Patient medications included Questran powder (cholestyramine), Advil (ibuprofen), Lonox, Provera, estrogen, vitamin E, and multiple vitamins. Family history included irritable bowel syndrome in the mother and the sibling(s), and atherosclerosis in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNNOT23 Library was constructed using 1 microgram of polyA RNA isolated from diseased colon tissue removed from a 16-year-old Caucasian male during a total colectomy with abdominal/perineal resection. Pathology indicated gastritis and pancolonitis consistent with the acute phase of ulcerative colitis. (The process is characterized by acute colitis with crypt abcess formation.) Inflammation was more severe in the transverse colon, with inflammation confined to the mucosa. There was only mild involvement of the ascending and sigmoid colon, and no significant involvement of the cecum, rectum, or terminal ileum. The patient presented with blood in the stool, anemia, abdominal pain, nausea, and vomiting. Patient medications included Minocin, Cephaxelin, Prednisone, Flagyl, Zantac (ranitidine), cortisone enemas, omrprazole, iron, dextran, and cyclosporin. Family history included irritable bowel syndrome, hypertension, and atherosclerotic coronary artery disease in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNNOT27 Library was constructed using 1 microgram of polyA RNA isolated from diseased cecal tissue removed from 31-year-old Caucasian male during a total intra-abdominal colectomy, appendectomy, and permanent ileostomy. Pathology indicated severe active Crohn's disease involving the colon from the cecum to the rectum. There were deep rake-like ulcerations which spared the intervening mucosa. The ulcers extended into the muscularis, and there was transmural inflammation. The ileum and appendix were uninvolved. The patient presented with enteritis and diarrhea. Patient history included an irritable colon. Previous surgeries included a colonscopy. Patient medications included Asacol (mesalamine), Flagyl (metronidazole), Azulfidine (sulfasalazine), and Prednisone (glucocorticoid). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNPOT01 Library was constructed using 1 microgram of polyA RNA isolated from colon polyp tissue removed from a 40-year-old Caucasian female during a total colectomy. Pathology indicated an inflammatory pseudopolyp; this tissue was associated with a focally invasive grade 2 adenocarcinoma and multiple tubuvillous adenomas. The patient presented with blood in the stool and anorexia nervosa. Patient history included a benign neoplasm of the bowel, anemia, and hypertension. Previous surgeries included a total abdominal hysterectomy and an adenotonsillectomy. Patient medications included HCTZ and ferrous sulfate. Family history included hypertension and hyperlipidemia in the father, and a malignant stomach neoplasm in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNTUT02 Library was constructed using 2 micrograms of polyA RNA isolated from colon tumor tissue removed from a 75-year-old Caucasian male during a hemicolectomy. Pathology indicated invasive grade 3 adenocarcinoma arising in a tubulovillous adenoma, which was distal to the ileocecal valve in the cecum. The tumor penetrated deeply into the muscularis propria but not through it. The patient presented with blood in his stool. Patient history included thrombophlebitis, chronic airway obstruction, atherosclerosis, cerebrovascular disease, and tobacco use. Previous surgeries included a cholecystectomy, appendectomy, and intracapsular extraction of the lens for phacolytic glaucoma. Patient medications included Betoptic (betaxol hydrocholoride) and pilocarpine hydrochloride for treatment of glaucoma, and Procardia (nifedipine). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

COLNTUT03 Library was constructed using 1 microgram of polyA RNA isolated from colon tumor tissue removed from the sigmoid colon of a 62-year-old Caucasian male during a sigmoidectomy and permanent colostomy. Pathology indicated invasive grade 2 adenocarcinoma, with invasion through the muscularis. Surgical margins were negative for tumor. One lymph node contained metastasis with extranodal extension. The patient presented with blood in his stool. Patient history included hyperlipidemia, cataract disorder, and dermatitis. Previous surgeries included a cholecystectomy and repair of indirect inguinal hernia. Patient medications included multivitamins, vitamin C, and iron supplements. Family history included benign hypertension, atherosclerotic coronary artery disease, and hyperlipidemia in the father; breast cancer in the mother; and prostate cancer in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNTUT06 Library was constructed using 1 microgram of polyA RNA isolated from colon tumor tissue removed from a 45-year-old Caucasian female during a total colectomy and total abdominal hysterectomy. Pathology indicated invasive grade 2 colonic adenocarcinoma forming a cecal mass, penetrating the muscularis propria and involving the serosa. The patient had also been diagnosed with benign neoplasms of the rectum and anus. Patient history included multiple sclerosis and mitral valve disorder. Previous surgeries included a polypectomy. Patient medications included Tagamet and iron supplements. Family history included Type I diabetes in the mother; cerebrovascular disease, atherosclerotic coronary artery disease and malignant skin neoplasm in the father; hypertension in a sibling, and atherosclerotic coronary artery disease and malignant neoplasm of the colon in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLNTUT15 Library was constructed using 7 nanograms of polyA RNA isolated from colon tumor tissue removed from a 64-year-old Caucasian female during a right hemicolectomy with ileostomy and bilateral salpingo-oopherectomy (removal of the fallopian tubes and ovaries). Pathology indicated an invasive grade 3 adenocarcinoma, forming a mass situated distal to the ileocecal valve. The neoplasm invaded through the muscularis propria and into the serosal fat, and abutted but did not invade an attached liver fragment. Multiple regional lymph nodes contained metastatic carcinoma; extranodal extension was identified. No vascular invasion was identified, and the surgical margins were free of tumor. Both ovaries and fallopian tubes showed no abnormality. Patient history included hypothyroidism, depression, and anemia. Patient medications included Synthroid (levothyroxine sodium). Family history included colon cancer in the father and uterine cancer in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

COLSUCT01 Library was constructed using 1 microgram of polyA RNA isolated from diseased sigmoid colon tissue removed from a 70-year-old Caucasian male during colectomy with permanent ileostomy. Pathology indicated chronic ulcerative colitis in the distal 25 cm of the colon with acute and chronic inflammation and architectural distortion in the area. Chronic ulcerative colitis was identified in the rectum and sigmoid colon. There was a hyperplastic polyp in the ascending colon. The remaining colon, terminal ileum, appendix, and anus showed no diagnostic abnormality. The patient presented with functional diarrhea and blood in the stool. Patient history included benign neoplasm of the colon, hyperlipidemia, benign hypertension, atrial fibrillation, and tobacco use. Patient medications included Asacol (mesalamine) for colitis, Prednisone (glucocorticoid), Coumadine, Lanoxin, Hygroton, Zestril, and Rowasa. Family history included atherosclerotic coronary artery disease and a myocardial infarction in the father, atherosclerotic coronary artery disease and a myocardial infarction in the mother, atherosclerotic coronary artery disease and a myocardial infarction in the sibling(s), and atherosclerotic coronary artery disease in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

CONNNOT01 Library was constructed using 1 microgram of polyA RNA isolated from mesentery fat tissue removed from a 71-year-old Caucasian male during a partial colectomy and permanent colostomy. This unaffected tissue was associated with diverticulosis and diverticulitis of the colon with abscess formation. Approximately 50 diverticula were noted, one of which was perforated and associated with abscess formation in adjacent mesenteric fat. During hospitalization, the patient experienced atrial fibrillation. The patient was taking Tegretol (carbamazepine). Patient history included a cholecystectomy, viral hepatitis, and a hemagioma. Family history included atherosclerotic coronary artery disease and myocardial infarction in the father, and extrinsic asthma in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

CONNTUT01 Library was constructed using 1 microgram of polyA RNA isolated from a soft tissue tumor removed from the clival area of the skull of a 30-year-old Caucasian female. Pathology indicated chondroid chordoma with neoplastic cells reactive for keratin. The patient presented with headache, diplopia, abnormality of gait, and sixth nerve palsy. Patient history included a normal delivery, deficiency anemia, and tobacco use. Previous surgeries included a cholecystectomy. Patient medications included Depo-Provera (medroxyprogesterone acetate). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

CONUTUT01 Library was constructed using 1 microgram of polyA RNA isolated from sigmoid mesentery tumor tissue removed from a 61-year-old female during a total abdominal hysterectomy and bilateral salpingo-oopherectomy with regional lymph node excision. Pathology indicated a metastatic grade 4 malignant mixed mullerian tumor present in the sigmoid mesentery at two sites. This tumor was associated with a grade 4 malignant mixed-mullerian tumor, heterologous type, of the uterus, forming a firm, infiltrating mass throughout the myometrium and involving the serosal surface. The heterologous elements of the tumor consisted of rhabdomyoblasts and immature cartilage. The tumor also involved the lower uterine segment and extended into the cervical wall. Extensive lymphatic and vascular permeation was identified in the myometrium and cervical wall. One (of 7) right common iliac and one (of 7) right external iliac lymph nodes were identified with metastatic grade 4 malignant mixed mullerian tumor, with the metastases comprised mainly of adenocarcinoma. There were also positive estrogen and progesterone receptors. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

CORNNOT01 Library was constructed at Stratagene (STR937222), using RNA isolated from the corneal fibroblasts of a 76-year-old. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances. The same Stratagene library was used for EYECNOM01, obtained from the WashU-Merck EST Project.

CORPNOT02 Library was constructed using 1 microgram of polyA RNA isolated from diseased corpus callosum tissue removed from the brain of a 74-year-old Caucasian male, who died from Alzheimer's disease. Serologies were negative. Patient history included sacral decubitus (bedsores). Previous surgeries included prostate surgery. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

CRBLNOT01 Library was constructed using 2 micrograms of polyA RNA isolated from the cerebellum tissue of a 69-year-old Caucasian male, who died from chronic obstructive pulmonary disease. Patient history included heart failure, myocardial infarction, hypertension, osteoarthritis, and tobacco use. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

DUODNOT01 Library was constructed using 0.81 micrograms of polyA RNA isolated from duodenal tissue removed from a 41-year-old Caucasian female during a radical pancreaticoduodenectomy. Pathology indicated a benign serous cystadenoma at the head of the pancreas. The cyst contained clear serous fluid, and no malignancy was identified. The patient presented with abdominal pain. Patient history included unspecified anxiety state and absence of menstruation. Family history included benign hypertension in the father, and malignant skin neoplasm in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

ENDANOT01 Library was constructed using 1 microgram of polyA RNA isolated from aortic endothelial cell tissue from an explanted heart removed from a male during a heart transplant. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

ENDCNOT01 Library was constructed using 1 microgram of polyA RNA isolated from endothelial cells removed from the coronary artery of a 58-year-old Hispanic male. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

ENDCNOT03 Library was constructed using 1 microgram of polyA RNA isolated from dermal microvascular endothelial cells removed from a neonatal Caucasian male. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

EOSIHET02 Library was constructed using RNA isolated from peripheral blood cells apheresed from a 48-year-old Caucasian male. Patient history included hypereosinophilia. Patient medications included hydroxyurea, allopruinol, warfarin, prednisone, and interferon alpha, ascorbic acid, and aspirin. The cell population was determined to be greater than 77% eosinophils by wright's staining. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

FIBRANT01 Library was constructed using 6 micrograms of polyA RNA isolated from an untreated ataxia telangiectasia fibroblast cell line (ATGD60). cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. FIBRAGT01 and FIBRAGT02 are related libraries made from ATGD60 cells.

FIBRNGT01 Library was constructed using 6 micrograms of polyA RNA isolated from a normal fibroblast cell line (GD23A). The cultured line was treated with 50 cGy of X-ray radiation, and RNA was collected 5 minutes after exposure. cDNA synthesis was initiated using an XhoI-oligo (dT) primer. Double-stranded cDNA was blunted, ligated to EcoRI adaptors, digested with XhoI, size-selected, and cloned into the XhoI and EcoRI sites of the Lambda UniZAP vector.

FIBRNGT02 Library was constructed using 6 micrograms of polyA RNA isolated from a normal fibroblast cell line (GD23A). The cultured line had been treated with 50 cGy of X-ray radiation, and RNA was collected 30 minutes after exposure. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

FIBRNOT01 Library was constructed at Stratagene (STR937212), using RNA isolated from the WI38 lung fibroblast cell line, which was derived from a 3-month-old Caucasian female fetus. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances. Actin screening indicated a frequency of 0.12% positive clones. The same Stratagene library was used for FIBRFEM01, obtained from the WashU-Merck EST Project.

GBLANOT02 Library was constructed using 7.5 nanograms of polyA RNA isolated from diseased gallbladder tissue removed from a 21-year-old Caucasian male during a cholecystectomy. Pathology indicated moderate chronic cholecystitis, cholelithiasis with 1 mixed stone, and acute serositis. The patient presented with abdominal pain, nausea, vomiting, and peritoneal effusion. Patient history included obesity, sleep apnea, and enuresis. Patient medications included Nasoconte (nasal decongestant). Family history included benign hypertention in the mother; Type II diabetes in the father; and benign hypertension, breast cancer, colon cancer and Type II diabetes in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

HEARFET01 Library was constructed using 0.6 micrograms of polyA RNA isolated from heart tissue removed from a Hispanic male fetus, who died at 18 weeks' gestation from fetal demise. Serology was negative. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

HEARNOT01 Library was constructed using RNA isolated from the whole heart tissue of a 56-year-old male, who died from an intracranial bleed. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

HIPONON02 This normalized brain library was constructed from 1.13 million independent clones from a hippocampus tissue library. Starting RNA was made from the hippocampus tissue of a 72-year-old Caucasian female, who died from a cerebrovascular accident. Patient history included nose cancer, hypertension, arthritis, and tobacco use. The patient was taking medication for hypertension. Serologies were negative. The library was oligo(dT)-primed, and cDNAs were cloned directionally into the pSPORT1 vectoring system using SalI (5') and Not1 (340). The normalization and hybridization conditions were adapted from Soares et al., *PNAS* (1994) 91: 9928, except that a significantly longer (48-hour) reannealing hybridization was used.

HIPONOT01 Library was constructed using RNA isolated from the hippocampus tissue of a 72-year-old Caucasian female, who died from an intercranial bleed. Patient history included nose cancer, arthritis, hypertension, and tobacco use. The patient was taking medication for hypertension. Serologies were negative. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

HMC1NOT01 Library was constructed using RNA isolated from the HMC-1 human mast cell line derived from a 52-year-old female. Patient history included mast cell leukemia. Family history included atherosclerotic coronary artery disease and a joint disorder involving multiple joints in the mother; and cerebrovascular disease, diabetes insipidus, and tobacco abuse in the father. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

HNT2AGT01 Library was constructed at Stratagene (STR937233), using RNA isolated from the hNT2 cell line, which was derived from a human teratocarcinoma that exhibited properties characteristic of a committed neuronal precursor at an early stage of development. Cells were treated with retinoic acid for five weeks, followed by treatment with mitotic inhibitors for two weeks, and then allowed to mature for an additional four weeks in conditioned medium. cDNA synthesis was initiated using an XhoI-oligo (dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances.

HNT2NOT01 Library was constructed at Stratagene (STR937230), using RNA isolated from the hNT2 cell line, which was derived from a human teratocarcinoma that exhibited properties characteristic of a committed neuronal precursor at an early stage of development. This library was made from untreated hNT2 cells. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances.

HNT2RAT01 Library was constructed at Stratagene (STR937231), using RNA isolated from the hNT2 cell line, which was derived from a human teratocarcinoma that exhibited properties characteristic of a committed neuronal precursor at an early stage of development. Cells were treated with retinoic acid for 24 hours. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances.

HNT3AZT01 Library was constructed using 1 microgram of polyA RNA isolated from the hNT2 cell line, which was derived from a human teratocarcinoma that exhibited properties characteristic of a committed neuronal precursor at an early stage of development. Cells were treated for three days with 0.35 micromolar 5-aza-2'-deoxycytidine (AZ). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte). HNT2AZS07 is another hNT2 cell library treated with AZ.

HUVELPB01 Library was constructed using RNA isolated from HUV-EC-C (ATCC CRL 1730) cells that were stimulated with cytokine/LPS. HUV-EC-C is an endothelial cell line derived from the vein of a normal human umbilical cord (ref: PNAS 81: 6413). RNA was isolated from two pools of HUV-EC-C cells that had been treated with either gamma IFN and TNF-alpha or IL-1 beta and LPS. In the first instance, HUV-EC-C cells were treated with 4 units/ml TNF and 2 units/ml IFNg for 96 hours at a density of 4.9×10e8 cells/ml. The yield was 1296 micrograms of total RNA, from which 11 micrograms of polyA was obtained (0.8% recovery). In the second instance, cells were treated with 1 units/ml IL-1 and 100 ng/ml LPS for 5 hours. Density was 1×108 cells/ml. The yield was 1000 micrograms of RNA, from which 5.3 micrograms of polyA was isolated (0.5% recovery). cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector HUVENOB01 Library was constructed using RNA isolated from unstimulated HUV-EC-C (ATCC CRL 1730) cells. HUV-EC-C is an endothelial cell line derived from the vein of a normal human umbilical cord (ref: PNAS 81: 6413). RNA was made by lysing 2×10e8 cells in GuSCN, followed by DNAse treatment. cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector.

HUVESTB01 Library was constructed using RNA isolated from shear-stressed HUV-EC-C (ATCC CRL 1730) cells. HUV-EC-C is an endothelial cell line derived from the vein of a normal human umbilical cord (ref: PNAS 81: 6413). Before RNA isolation, the cells were subjected to a shear stress of 10 dynes/cm. cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector.

HYPONOB01 Library was constructed using RNA isolated from the hypothalamus tissue of 51 male and female Caucasian donors, 16 to 75 years old. (RNA came from Clontech, CLON 6579-2, lot 3×843.) PolyA RNA size was 0.5–9 kb. cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector.

ISLTNOT01 Library was constructed using 1 microgram of polyA RNA isolated from pancreatic islet cells. Starting RNA was made from a pooled collection of islet cells. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

KERANOT01 Library was constructed using 1 microgram of polyA RNA isolated from neonatal keratinocytes obtained from the leg skin of a spontaneously aborted black male. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

KERANOT02 Library was constructed using 1 microgram of polyA RNA isolated from epidermal breast keratinocytes (NHEK). NHEK (Clontech #CC-2501) is human breast keratinocyte cell line derived from a 30-year-old black female during breast-reduction surgery. Patient history included elevated blood pressure, and tobacco and alcohol use. Patient medications included Motrin and Tylenol. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

KIDNOT02 Library was constructed using RNA isolated from the kidney tissue of a 64-year-old Caucasian female, who died from an intracranial bleed. Serology was positive for hepatitis B. Patient history included hypertension, rheumatoid arthritis, and tobacco use. Patient medications included Dopamine. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

KIDNNOT05 Library was constructed using 1.8 micrograms of polyA RNA isolated from the kidney tissue of a 2-day-old Hispanic female, who died from cerebral anoxia. Serologies were negative. Family history included congenital heart disease in the mother's family. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

KIDNNOT09 Library was constructed using 1 microgram of polyA RNA isolated from the kidney tissue of a Caucasian male fetus, who died at 23 weeks' gestation from premature birth. Serology was negative. Family history included diabetes in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

KIDNTUT01 Library was constructed using 1 microgram of polyA RNA isolated from the kidney tumor tissue removed from an 8-month-old female during nephroureterectomy. Pathology indicated Wilms' tumor (nephroblastoma), which involved 90 percent of the renal parenchyma. A capsular blood vessel showed tumor involvement, but no invasion of the perirenal adipose tissue, renal vein, or renal pelvis was found, and no metastases into the lymph nodes were detected. Prior to surgery, the patient was receiving heparin anticoagulant therapy. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

LATRNOT01 Library was constructed using 9 micrograms of polyA RNA isolated from the left atrium of a 51-year-old Caucasian female, who died from an intracranial bleed. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

LATRTUT02 Library was constructed using 1 microgram of polyA RNA isolated from a myoma removed from the left atrium of a 43-year-old Caucasian male during annuloplasty. Pathology indicated atrial myxoma. Patient history included pulmonary insufficiency, benign hypertension, acute myocardial infarction, atherosclerotic coronary artery disease, hyperlipidemia, and tobacco use. Family history included benign hypertension in the mother and a grandparent, acute myocardial infarction and atherosclerotic coronary artery disease in the father, and Type II diabetes in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LEUKNOT02 Library was constructed using 1 microgram of polyA RNA isolated from white blood cells of a 45-year-old female with blood type O+. The donor tested positive for cytomegalovirus (CMV). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LEUKNOT03 Library was constructed using 1 microgram of polyA RNA isolated from white blood cells of a 27-year-old female with blood type A+. The donor tested negative for cytomegalovirus (CMV). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LIVRBCT01 Library was constructed using 5 micrograms of polyA RNA isolated from the liver tissue of a patient with primary biliary cirrhosis who had a liver transplant. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

LIVRFET02 Library was constructed using 1 microgram of polyA RNA isolated from liver tissue removed from a Caucasian female fetus, who died at 20 weeks' gestation from fetal demise. Serolog was negative. Family history included seven days of erythromycin treatment for bronchitis in the mother during the first trimester. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LIVRNOT01 Library was constructed at Stratagene, using RNA isolated from the liver tissue of a 49-year-old male. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances. The same Stratagene library (STR937224) was used for LIVRNOM01, obtained from the WashU-Merck EST Project.

LIVRTUT01 Library was constructed using 1 microgram of polyA RNA isolated from liver tumor tissue removed from a 51-year-old Caucasian female during a hepatic lobectomy. Pathology indicated metastatic grade 3 adenocarcinoma consistent with colon cancer. The surgical margins were negative for tumor. Patient history included thrombophlebitis and pure hypercholesterolemia. Previous surgeries included a total abdominal hysterectomy. Patient medications included Premarin and Provera. The patient had also received 8 cycles of fluorouracil and leucovorin in the two years prior to surgery. Family history included a malignant neoplasm of the liver in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LIVRTUT04 Library was constructed using 7.5 nanograms of polyA RNA isolated from liver tumor tissue removed from a 50-year-old Caucasian male during a partial hepatectomy. Pathology indicated a grade 3–4 hepatoma, forming a mass. Surgical margins were free of tumor. No lymphovascular invasion was seen. The adjacent liver showed mild portal fibrosis with lymphoid aggregates and mild steatosis. Patient history included benign hypertension and hepatitis. The patient was classified as a carrier because hepatitis B core antigen and hepatitis B surface antigen, DNA negative were positive. Patient medications included atenolol. cDNA synthesis was initiated using a NotI-oligo (dT) primer. Double-stranded cDNA was blunted, ligated to EcoRI adaptors, digested with NotI, size-selected, and cloned into the NotI and EcoRI sites of the pINCY vector (Incyte).

LNODNOT02 Library was constructed using 1 microgram of polyA RNA isolated from the lymph node tissue of a 42-year-old Caucasian female, who died of cardiac arrest. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

LNODNOT03 Library was constructed using 1 microgram of polyA RNA isolated from lymph node tissue removed from a 67-year-old Caucasian male during a segmental lung resection and bronchoscopy. On microscopic exam, this tissue was found to be extensively necrotic with 10% viable tumor. Pathology for the associated tumor tissue indicated invasive grade 3–4 squamous cell carcinoma, forming a mass in the right lower lobe, which grossly puckers the pleura. Microscopically, tumor invaded into but not through the visceral pleura. Focally, tumor was seen obliterating the bronchial lumen. The bronchial margin was negative for dysplasia/neoplasm. One of two intrapulmonary lymph nodes was metastatically involved. One of four inferior mediastinal (subcarinal) and two of eight superior mediastinal (right lower paratracheal) lymph nodes were metastatically involved. Multiple lymph nodes were negative for tumor. A small component of grade 3 adenocarcinoma was present in the tumor, which manifested itself most prominently in some of the metastases in the regional lymph nodes. The patient presented with a cough. Patient history included hemangioma and tobacco abuse. Previous surgeries included appendectomy. Patient medications included doxycycline. Family history included atherosclerotic coronary artery disease, benign hypertension, and congestive heart failure in the mother; atherosclerotic coronary artery disease and congestive heart failure in the father; and atherosclerotic coronary artery disease in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LUNGAST01 Library was constructed using 2 micrograms of polyA RNA isolated from the lung tissue of a 17-year-old Caucasian male, who died from head trauma. The patient had a history of asthma. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

LUNGFET03 Library was constructed using 1 microgram of polyA RNA isolated from lung tissue removed from a Caucasian female fetus, who died at 20 weeks' gestation from fetal demise. Serology was negative. Family history included seven days of erythromycin treatment for bronchitis in the mother during the first trimester. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LUNGNOT02 Library was constructed using RNA isolated from the lung tissue of a 47-year-old Caucasian male, who died of a subarachnoid hemorrhage. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

LUNGNOT03 Library was constructed using 1 microgram of polyA RNA isolated from nontumorous lung tissue of a 79-year-old Caucasian male. Tissue had been removed from the upper and lower left lobes of the lung, superior (left paratracheal) and inferior (subclavian) mediastinal lymph nodes, and the right paratracheal region. Pathology for the associated tumor tissue indicated grade 4 carcinoma of the upper and lower left lobes, having multiple Hurthle cell features consistent with thyroid cancer. Special stains performed on subclavian lymph nodes were negative for fungi and acid-fast organisms, but did not show non-necrotizing granulomatous inflammation. Non-specific scarring was found in the parenchyma of the right paratracheal region. Patient history included a benign prostate neoplasm, atherosclerosis, benign hypertension, and tobacco use. Previous surgeries included anomalous atrioventricular excitation and a complete thyroidectomy. Patient medications included Atenolol for hypertension, Synthroid (levothyroxine sodium) for hypothyroidism, and aspirin. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

LUNGNOT04 Library was constructed using 1.6 micrograms of polyA RNA isolated from the lung tissue of a 2-year-old Hispanic male, who died from cerebral anoxia. Past medical history and serologies were negative. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

LUNGNOT09 Library was constructed using 1 microgram of polyA RNA isolated from the lung tissue of a 23-week-old Caucasian male fetus. The pregnancy was terminated following a diagnosis by ultrasound of infantile polycystic kidney disease. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LUNGNOT10 Library was constructed using 1 microgram of polyA RNA isolated from the lung tissue of a Caucasian male fetus, who died at 23 weeks' gestation from premature birth. Serology was negative. Family history included diabetes in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LUNGNOT12 Library was constructed using 0.464 micrograms of polyA RNA isolated from nontumorous lung tissue removed from a 78-year-old Caucasian male during a segmental lung resection and regional lymph node resection. Surgery followed a diagnosis of a malignant neoplasm of the right upper lobe. Pathology indicated fibrosis pleura was puckered, but not invaded. Pathology for the associated tumor tissue indicated an invasive pulmonary grade 3 adenocarcinoma, forming a peripheral mass with associated fibrosis. The patient presented with premature ventricular beats. Patient history included cerebrovascular disease, arteriosclerotic coronary artery disease, thrombophlebitis, chronic obstructive pulmonary disease, asthma, and tobacco use. Previous surgeries included a cholecystectomy, radical prostatectomy, and regional lymph node excision for malignant prostate neoplasm. Patient medications included Cipro I.V. (ciprofloxacin) for a systemic infection; Atenolol (tenormin) for arrhythmia; Darvocet-N (propoxyphene napsylate) for pain; Naprosyn (naproxen), an anti-inflammatory and analgesic; and multivitamins. Family history included intracranial hematoma with deep coma following injury in the mother, and cerebrovascular disease, arteriosclerotic coronary artery disease, and Type I diabetes in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LUNGNOT18 Library was constructed using 1 microgram of polyA RNA isolated from nontumorous lung tissue removed from the left upper lobe of a 66-year-old Caucasian female during a segmental lung resection and regional lymph node biopsy. Pathology for the associated tumor tissue indicated a grade 2 adenocarcinoma with bronchoalveolar features and prominent inflammation, forming a well-circumscribed nodular mass. The tumor did not involve the pleura. Surgical margins and lymph nodes were negative for tumor. Patient history included cerebrovascular disease, atherosclerotic coronary artery disease, pulmonary insufficiency, and a normal delivery. Previous surgeries included an endarterectomy. Patient medications included Trental, Zocor, and aspirin. Family history included a myocardial infarction in the mother and father, and atherosclerotic coronary artery disease in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LUNGTUT02 Library was constructed using 1.4 micrograms of polyA RNA isolated from the metastatic lung tumor tissue of a 79-year-old Caucasian male. Tissue had been removed from the upper and lower left lobes of the lung, superior (left paratracheal) and inferior (subclavian) mediastinal lymph nodes, and the right paratracheal region. Pathology indicated a grade 4 carcinoma of the upper and lower left lobes, having multiple Hurthle cell features consistent with thyroid cancer. Special stains performed on subclavian lymph nodes were negative for fungi and acid-fast organisms, but did not show non-necrotizing granulomatous inflammation. Non-specific scarring was found in the parenchyma of the right paratracheal region. Patient history included a benign prostate neoplasm, atherosclerosis, benign hypertension, and tobacco use. Previous surgeries included anomalous atrioventricular excitation and a complete thyroidectomy. Patient medications included Atenolol for hypertension, Synthroid (levothyroxine sodium) for hypothyroidism, and aspirin. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

LUNGTUT03 Library was constructed using 1 microgram of polyA RNA isolated from lung tumor tissue removed from the left lower lobe of a 69-year-old Caucasian male during segmental lung resection. Pathology indicated residual grade 3 invasive squamous cell carcinoma, bordering but not invading the pleura. The upper lobe also contained residual grade 3 invasive squamous cell carcinoma. Surgical margins and lymph nodes were negative for tumor. Patient history included acute myocardial infarction, prostatic hyperplasia, benign hypertension, malignant skin neoplasm, and tobacco use. Previous surgeries included a multivessel coronary artery bypass. Patient medications included Hytrin (terazosin) for benign prostate hyperplasia; Norvasc (amiodipine besylate) for angina; Atenolol (tenormin) for arrhythmia; KCL (potassium chloride); Lasix (furosemide), a diuretic; and blood-pressure medicine. Family history included cerebrovascular disease and Type I diabetes in the mother, and acute myocardial infarction and arteriosclerotic coronary disease in the father. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

LUNGTUT06 Library was constructed using 0.5 micrograms of polyA RNA isolated from apical lung tumor tissue removed from an 80-year-old Caucasian female during a segmental lung resection. Pathology indicated a metastatic granulosa cell tumor, forming a mass at the posterior upper lobe and superior lower lobe of the right lung. Metastatic granulosa cell tumor formed two encapsulated subpleural nodules at the left lung apex and left parietal pleura. The lung parenchyma was unremarkable. Pleural fibrosis was identified at the right lung apex and the right and left lower lung lobes; however, there was no evidence of malignancy. Patient history included benign hypertension, nonspecific reaction to a tuberculin skin test, pelvic soft tissue tumor, and acquired antibody E from a previous transfusion. The patient also underwent chemotherapy for one year. Previous surgeries included a soft tissue excision, total abdominal hysterectomy, open liver biopsy, and bladder surgery. Patient medications included Cisplatin, Velban, Bleomycin, Noragesic and Metamucil. Family history included tuberculosis in the father, benign hypertension in the mother, and lung cancer and atherosclerotic coronary artery disease in the sibling(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LUNGTUT07 Library was constructed using 0.5 micrograms of polyA RNA isolated from lung tumor tissue removed from the upper lobe of a 50-year-old Caucasian male during segmental lung resection. Pathology indicated an invasive grade 4 squamous cell adenocarcinoma forming a subpleural mass, which puckered the underlying pleura. The tumor did not infiltrate the pleura. Reactive mesothelial cells and fibrin were present at the right lower lobe of pleural implant. The bronchial margin and multiple lymph nodes were negative for tumor. The patient presented with a respiratory anomaly and chest pain. Patient history included alcohol and tobacco use. Previous surgeries included a cholecystectomy. Patient medications included Tylenol with codeine and multivitamins. Family history included alcohol use and skin cancer in the mother; alcohol use in the father, and skin cancer in the sibling(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LUNGTUT09 Library was constructed using 0.5 micrograms of polyA RNA isolated from lung tumor tissue removed from a 68-year-old Caucasian male during segmental lung resection. Pathology indicated invasive grade 3 squamous cell carcinoma in the right upper lobe, forming an infiltrating mass involving the bronchus and the surrounding parenchyma. The bronchial margin, bronchus intermedius, and proximal margin were negative for tumor. One (of 4) intrapulmonary peribronchial lymph nodes contained a metastatic tumor. An apical cap was identified. One (of 15) right paratracheal lower lymph nodes contained a metastatic tumor. Permanent superior mediastinal sections revealed metastatic squamous cell carcinoma in the lymph nodes. The patient presented with chest pain and pneumonia. Patient history included of Type II diabetes, thyroid disorder, depressive disorder, hyperlipidemia, esophageal ulcer, and tobacco and alcohol use. Patient medications included Glyburide for controlling blood glucose, Glucophage for controlling blood sugar, Synthroid (levothyroxine sodium, Propulsid, Cimetidine, Claritin, Prozac (fluoxetine hydrochoride), Ativan, and Vantin. Family history included alcohol use in the father, alcohol use and brain cancer in the mother, atherosclerotic coronary artery disease in the sibling (s), and atherosclerotic coronary artery disease in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

LVENNOT01 Library was constructed using RNA isolated from the left ventricle of a 51-year-old Caucasian female, who died from an intracranial bleed. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

LVENNOT02 Library was constructed using 3.0 micrograms of polyA RNA isolated from the left ventricle of a 39-year-old Caucasian male, who died from a gunshot wound. Serology was positive for cytomegalovirus (CMV). Patient history included tobacco use (one pack of cigarettes per day for 25 years), and occasionally cocaine, marijuana, and alcohol use. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

LVENNOT03 Library was constructed using 5 micrograms of polyA RNA isolated from the left ventricle tissue of a 31-year-old male. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

MENITUT03 Library was constructed using 1 microgram of polyA RNA isolated from brain meningioma tissue removed from a 35-year-old Caucasian female during excision of a cerebral meningeal lesion. Pathology indicated a benign neoplasm in the right cerebellopontine angle of the brain. The patient presented with headache and deficiency anemia. Patient history included hypothyroidism. Patient medications included Synthroid. Family history included a myocardial infarction in the father, breast cancer in the mother, alcohol abuse in the grandparent(s), and drug-induced mental disorder in the sibling(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

MMLR1DT01 Library was constructed using 2 micrograms of polyA RNA isolated from adherent mononuclear cells, which came from a pool of male and female donors. The cells were cultured for 24 hours following Ficoll Hypaque centrifugation. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

MMLR2DT01 Library was constructed using 2 micrograms of polyA RNA isolated from plastic adherent mononuclear cells, which were collected on day two of a 2-way mixed lymphocyte (MLR) culture. The cells were isolated from buffy coat units obtained from unrelated male and female donors at the Stanford Blood Bank. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

MMLR3DT01 Library was constructed using 2 micrograms of polyA RNA isolated from adherent mononuclear cells, which came from a pool of male and female donors. The cells were cultured for 72 hours following Ficoll Hypaque centrifugation. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

MPHGLPT02 Library was constructed using 1 microgram of polyA RNA isolated from adherent mononuclear cells, which came from a pool of male and female donors. The cells were isolated using Ficoll Hypaque centrifugation, and the predominantly macrophage-containing population was stimulated with LPS at 1 $\mu$g/ml for 2 hours before isolation of total RNA and polyA selection. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

MPHGNOT03 Library was constructed using 4 micrograms of polyA RNA isolated from plastic adherent (2 hour culture) mononuclear cells isolated from buffy coat units obtained from unrelated male and female donors. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

MUSCNOT01 Library was constructed at Stratagene (STR937209), using RNA isolated from the skeletal muscle tissue of a patient with malignant hyperthermia. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances. Actin screening indicated a frequency of 4.45% positive clones.

MUSCNOT02 Library was constructed using 1 microgram of polyA RNA isolated from the psoas muscle tissue of a 12-year-old Caucasian male. Serology was positive for cytomegalovirus (CMV). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

MYOMNOT01 Library was constructed using 1 microgram of polyA RNA isolated from nontumerous uterine myometrial tissue removed from a 43-year-old Caucasian female during a vaginal hysterectomy and bilateral salpingo-oophorectomy (removal of the fallopian tubes and ovaries). Pathology indicated no diagnostic abnormality. The patient presented with dysmenorrhea, stress incontinence, genital prolapse and excessive menstruation. Patient history included cystic mastopathy, abdominal pregnancy, retinal dystrophy, pneumonia, and tobacco use. Previous surgeries included multiple D&C's and bilateral fallopian tube destruction. Patient medications included Advil. Family history included lung cancer, stroke, drug use, Type II diabetes, hepatic lesion, chronic liver disease and hyperlipidemia in the father; tobacco, alcohol, and drug use in the mother; and congenital heart anomaly, drug use, mitral valve prolapse and depression in the sibling(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

NEUTFMT01 Library was constructed using total RNA isolated from peripheral blood granulocytes collected by density gradient centrifugation through Ficoll-Hypaque. The cells were isolated from buffy coat units obtained from unrelated male and female donors. Cells were cultured in 10 nm fMLP for 30 minutes, lysed in GuSCN, and spun through CsCl to obtain RNA for library construction. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Because this library was made from total RNA, it has an unusually high proportion of unique singleton sequences, which may not all come from polyA RNA species.

NEUTGMT01 Library was constructed using 1 microgram of polyA RNA isolated from peripheral blood granulocytes collected by density gradient centrifugation through Ficoll-Hypaque. The cells were isolated from buffy coat units obtained from 20 unrelated male and female donors. Cells were cultured in 10 nM GM-CSF for 1 hour before washing and harvesting for total RNA preparation. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

NEUTLPT01 Library was constructed using 64 micrograms of total RNA isolated from peripheral blood granulocytes collected by density gradient centrifugation through Ficoll-Hypaque. The cells were isolated from buffy coat units obtained from unrelated male and female donors. Cells were cultured in 100 ng/ml *E. coli* LPS for 30 minutes, lysed in GuSCN, and spun through CsCl to obtain RNA for library construction. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Because this library was made from total RNA, it has an unusually high proportion of unique singleton sequences, which may not all come from polyA RNA species.

NGANNOT01 Library was constructed using 1 microgram of polyA RNA isolated from tumorous neuroganglion tissue removed from a 9-year-old Caucasian male during a soft tussue excision of the chest wall. Pathology indicated a ganglioneuroma forming an encapsulated lobulated mass. The tissue from the medial aspect pleura surrounding the tumor showed fibrotic tissue with chronic inflammation that extended into the overlying adipose tissue. The patient presented with a cough. The patient was not taking any medications. Family history included asthma in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

OVARNOT02 Library was constructed using 1 microgram of polyA RNA isolated from ovarian tissue removed from a 59-year-old Caucasian female, who died of a myocardial infarction. Patient history included cardiomyopathy, coronary artery disease, previous myocardial infarctions, hypercholesterolemia, hypotension, arthritis, and tobacco use. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

OVARNOT03 Library was constructed using 1 microgram of polyA RNA isolated from nontumorous ovarian tissue removed from a 43-year-old Caucasian female during a bilateral salpingo-oopherectomy (removal of the fallopian tubes and ovaries). Pathology for the associated tumor tissue indicated grade 2 mucinous cystadenocarcinoma. Staging biopsies and lymph nodes were negative for tumor. The patient presented with stress incontinence. Patient history included mitral valve disorder, pneumonia, and viral hepatitis. Patient medications included ferrous sulfate, Metamucil, and ibuprofen. Family history included atherosclerotic coronary artery disease in the father; pancreatic cancer in the mother; stress reaction in the sibling(s); and cerebrovascular disease, breast cancer, and uterine cancer in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

OVARNOT09 Library was constructed using 7.5 nanograms of polyA RNA isolated from ovarian tissue removed from a 28-year-old Caucasian female during a vaginal hysterectomy and bilateral salpingo-oophorectomy (removal of the fallopian tubes and ovaries). Pathology indicated multiple follicular cysts ranging in size from 0.4 to 1.5 cm in the right and left ovaries, chronic cervicitis and squamous metaplasia of the cervix, and endometrium in weakly proliferative phase. The fallopian tubes were without diagnostic abnormality. The patient presented with abdominal pain. Patient history included a normal delivery, calculus of the kidney, and an irritable colon. The patient was taking Depo-Provera (medroxyprogesterone acetate) for approximately 1–2 years. Family history included benign hypertension and hyperlipidemia in the father, and atherosclerotic coronary artery disease in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

OVARTUT01 Library was constructed using 1 microgram of polyA RNA isolated from ovarian tumor tissue removed from a 43-year-old Caucasian female during a bilateral salpingo-oopherectomy (removal of the fallopian tubes and ovaries). Pathology indicated grade 2 mucinous cystadenocarcinoma of the left ovary, and also involving the entire ovary. The left and right fallopian tube and ovary showed no diagnostic abnormality. Staging biopsies and lymph nodes were negative for tumor. The patient presented with stress incontinence. Patient history included mitral valve disorder, pneumonia, and viral hepatitis. Patient medications included ferrous sulfate, Metamucil, and ibuprofen. Family history included atherosclerotic coronary artery disease in the father; pancreatic cancer in the mother; stress reaction in the sibling(s); and cerebrovascular disease, breast cancer, and uterine cancer in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

OVARTUT02 Library was constructed using 0.5 micrograms of polyA RNA isolated from ovarian tumor tissue removed from a 51-year-old Caucasian female during an exploratory laparotomy, total abdominal hysterectomy, salpingo-oopherectomy, and an incidental appendectomy. Pathology indicated mucinous cystadenoma presenting as a multiloculated neoplasm involving the entire left ovary. The right ovary contained a follicular cyst and a hemorrhagic corpus luteum. The left and right fallopian tubes, appendix, and cervix were unremarkable. The uterus showed proliferative endometrium and a single intramural leiomyoma. The peritoneal biopsy indicated benign glandular inclusions consistent with endosalpingiosis. The patient presented with abnormal weight gain and ascites. Patient history included depressive disorder, joint pain, allergies, alcohol use, and a normal delivery. The patient was not taking any medications. Family history included atherosclerotic coronary artery disease in the father, benign hypertention in the mother, breast cancer and uterine cancer in the sibling(s), and atherosclerotic coronary artery disease in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

OVARTUT04 Library was constructed using 7.5 nanograms of polyA RNA isolated from ovarian tumor tissue removed from a 53-year-old Caucasian female during a total abdominal hysterectomy, salpingo-oopherectomy (removal of the fallopian tubes and ovaries), regional lymph node excision, peritoneal tissue destruction, and incidental appendectomy. Pathology indicated grade 1 transitional cell carcinoma of the right ovary forming a solid and cystic mass with a smooth and uninvolved external surface. The left ovary had a hemorrhagic corpus luteum. The uterus had multiple leiomyomas (1 submucosal, 11 intramural), and the endometrium was inactive. The cervix was unremarkable. The appendix, omentum, right lymphadenectomy tissue, cul-de-sac, right pelvic sidewall, bladder peritoneum, right and left pericolic gutter, and diaphragm were all negative for tumor. The cul-de-sac contained abundant histiocytes and rare clusters of mesothelial cells. The patient presented with abdominal pain and anemia. Patient history included breast fibrosclerosis, a chronic stomach ulcer, a normal delivery, and heartburn. Previous surgeries included a closed stomach biopsy and a D&C. Patient medications included Tagamet. Family history included an acute stomach ulcer with perforation in the father; breast cancer, bladder cancer, rectal/anal cancer, benign hypertention, coronary angioplasty, and hyperlipidemia in the sibling(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

OVARTUT05 Library was constructed using 7.5 nanograms of polyA RNA isolated from ovarian tumor tissue removed from a 62-year-old Caucasian female during a total abdominal hysterectomy, salpingo-oopherectomy (removal of the fallopian tubes and ovaries), exploratory laparotomy, regional lymph node excision, and D&C. Pathology indicated a grade 4 endometnoid carcinoma with extensive squamous differentiation, forming a solid mass in the right ovary. The uterine endometrium was inactive, the cervix showed mild chronic cervicitis, and focal endometriosis was observed in the posterior uterine serosa. Curettings indicated weakly proliferative endometrium with excessive stromal breakdown in the uterus, and a prior cervical biopsy indicated a mild chronic cervicitis with a prominent nabothian cyst in the cervix. The left ovary and fallopian tube, appendix, omentum, multiple lymph nodes, and all staging biopsies were negative for tumor. The patient presented with anemia and unspecified abdominal/pelvic symptoms. Patient history included a normal delivery, longitudinal deficeincy of the radioulna, osteoarthritis, thrombophlebitis, abnormal blood chemistries, and tobacco use. Previous surgeries included an open breast biopsy. The patient was not taking any medications. Family history included atherosclerotic coronary artery disease and pulmonary embolism in the mother, and cerebrovascular disease in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PANCDIT01 Library was constructed using polyA RNA isolated from pancreas tissue removed from a15-year-old Caucasian male, who died from a self-inflicted gunshot wound. Patient history included Type I diabetes. Previous surgeries included an appendectomy. Patient medications included insulin. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

PANCDIT03 Library was constructed using polyA RNA isolated from pancreas tissue removed from a 57-year-old Caucasian male, who died from a basal-cell ganglia bleed. Patient history included Type II diabetes, hypertension, and cerebrovascular disease. Patient medications included Micronase. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

PANCNOT01 Library was constructed using RNA isolated from the pancreatic tissue of a 29-year-old Caucasian male, who died from head trauma. Serologies were positive for cytomegalovirus (CMV) but otherwise negative. Patient history included alcohol, marijuana, and tobacco use. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

PANCNOT05 Library was constructed using 1.6 micrograms of polyA RNA isolated from the pancreatic tissue of a 2-year-old Hispanic male, who died from cerebral anoxia. Past medical history and serologies were negative. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

PANCNOT07 Library was constructed using 1 microgram of polyA RNA isolated from the pancreatic tissue of a Caucasian male fetus, who died at 23 weeks' gestation from premature birth. Serology was negative. Family history included diabetes in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PANCTUT01 Library was constructed using 1 microgram of polyA RNA isolated from pancreatic tumor tissue removed from a 65-year-old Caucasian female during radical subtotal pancreatectomy. Pathology indicated an invasive grade 2 adenocarcinoma (80%), forming a 2.5×2.3×2 cm mass at the tail of the pancreas, 1.5 cm from the proximal margins of resection. The surrounding parenchyma showed marked chronic pancreatitis and dilatation of the main pancreatic duct distal to the tumor mass. Multiple peripancreatic and omental lymph nodes were negative for tumor. The patient presented with abdominal pain, Type II diabetes, and abnormal weight loss. Patient history included osteoarthritis, benign hypertension, atherosclerotic coronary artery disease, an acute myocardial infarction, benign neoplasm in the large bowel, a cataract disorder, and tobacco use. Previous surgeries included a total splenectomy, cholecystectomy, and abdominal hysterectomy. Patient medications included Micronase (glyburide) for blood glucose control and Premarin (conjugated estrogen). Family history included benign hypertension and atherosclerotic coronary artery disease in the mother and father, Type II diabetes and impaired renal function in the father, and stomach cancer in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PANCTUT02 Library was constructed using 1 microgram of polyA RNA isolated from pancreatic tumor tissue removed from a 45-year-old Caucasian female during radical pancreaticoduodenectomy. Pathology indicated a grade 4 anaplastic carcinoma at the head of the pancreas. The tumor infiltrated and ulcerated the duodenal mucosa. Surgical margins and lymph nodes were negative for tumor. The patient presented with abdominal pain, diarrhea, nausea, and vomiting. Patient history included tobacco use. Patient medications included Tylenol with codeine, Reglan, and progesterone. Family history included benign hypertension and hyperlipidemia in the the mother, and atherosclerotic coronary artery disease in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PENITUT01 Library was constructed using 1 microgram of polyA RNA isolated from tumor tissue removed from the penis of a 64-year-old Caucasian male during penile amputation. Pathology indicated a fungating invasive grade 4 squamous cell carcinoma involving the inner wall of the foreskin and extending onto the glans penis. The tumor involved the glans but did not involve Buck's fascia or corpora cavernosa. The patient presented with hematura, edema of the penis, and deficiency anemia. Patient history included benign neoplasm of the large bowel, atherosclerotic coronary artery disease, angina pectoris, gout, obesity, and tobacco and alcohol use. The patient was taking allopurinal to reduce serum and uric acid concentrations in urine. Family history included a malignant neoplasm of the pharynx in the father, chronic lymphocytic leukemia in the mother and a sibling, and chronic liver disease in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PGANNOT01 Library was constructed using 2.5 micrograms of polyA RNA isolated from paraganglionic tumor tissue removed from the intra-abdominal region of a 46-year-old Caucasian male during exploratory laparotomy. Pathology indicated a benign paraganglioma and was associated with a grade 2 renal cell carcinoma, clear cell type, which did not penetrate the capsule. Surgical margins were negative for tumor. The patient presented with headache, backache, malignant hypertension, nausea and vomiting. Previous surgeries included a hernia repair. Patient medications included Lasix (furosemide), Inderal (propranol hydrochloride), and Procardia (nifedipine). Family history included cerebrovascular disease in the mother, atherosclerotic coronary artery disease and a myocardial infarction in the father, and Type II diabetes in the sibling(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

PGANNOT03 Library was constructed using 2.5 micrograms of polyA RNA isolated from paraganglionic tumor tissue removed from a 46-year-old Caucasian male during exploratory laparotomy. Pathology indicated a benign paraganglioma and was associated with a grade 2 renal cell carcinoma, clear cell type, which did not penetrate the capsule. Surgical margins were negative for tumor. The patient presented with headache, backache, malignant hypertension, nausea and vomiting. Previous surgeries included a hernia repair. Patient medications included Lasix (furosemide), Inderal (propranol hydrochloride), and Procardia (nifedipine). Family history included cerebrovascular disease in the mother, atherosclerotic coronary artery disease and a myocardial infarction in the father, and Type II diabetes in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PITUNOR01 Library was constructed using RNA isolated from the normal pituitary glands of 18 male and female Caucasian donors, 16 to 70 years old, who died from trauma. (RNA came from Clontech, CLON 6584-2, lot 35278.) RNA was isolated by a modified GuSCN method, followed by two rounds of polyA RNA selection on oligo(dT)-cellulose columns. PolyA RNA size was 0.2–5 kb. PolyA RNA gave a discrete band in a Northern Blot upon hybridization with a human beta-actin cDNA probe. cDNA synthesis was initiated using a random primer. Double-stranded cDNA was blunted, ligated to EcoRI adaptors, digested with XhoI, size-selected, and cloned into the XhoI and EcoRI sites of the Lambda UniZAP vector.

PITUNOT01 Library was constructed using RNA isolated from the normal pituitary glands of 18 male and female Caucasian donors, 16 to 70 years old, who died from trauma. (RNA came from Clontech, CLON 6584-2, lot 35278.) RNA was isolated by a modified GuSCN method, followed by two rounds of polyA RNA selection on oligo(dT)-cellulose columns. PolyA RNA size was 0.2–5 kb. PolyA RNA gave a discrete band in a Northern Blot upon hybridization with a human beta-actin cDNA probe. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

PITUNOT02 Library was constructed using 1 microgram of RNA isolated from the pituitary gland of 87 male and female donors, 15 to 75 years old. (RNA acquired from Clontech, CLON 6584-1.) cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

PLACNOB01 Library was constructed using RNA isolated from normal placenta. The RNA was isolated using GuSCN lysis and acid phenol extraction. cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector.

PLACNOT02 Library was constructed using 1 microgram of polyA RNA isolated from the placental tissue of a Hispanic female fetus who was prematurely delivered at 21 weeks' gestation. Serologies of the mother's blood were positive for CMV but otherwise negative. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSNON01 This normalized prostate library was constructed from 4.4 million independent clones from the PROSNOT11 library. Starting RNA was made from prostate tissue removed from a 28-year-old Caucasian male, who died from a self-inflicted gunshot wound. Serologies were negative. Patient history included alcohol and tobacco use. The patient was not taking any medications. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector. The normalization and hybridization conditions were adapted from Soares et al., *PNAS* (1994) 91: 9928, except that a longer (19-hour) reannealing hybridization was used.

PROSNOT01 Library was constructed using RNA isolated from the prostate tissue of a 78-year-old Caucasian male, who died from leukemia. Serologies were negative. Patient history included skin cancer, emphysema, asthma, and alcohol use. Previous surgeries included a cholecystectomy. Patient medications included Hydrea (hydroxyurea). cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

PROSNOT02 Library was constructed using 400 nanograms of polyA RNA isolated from the nontumorous prostate tissue removed from a 50-year-old Caucasian male during a retropubic prostatectomy. Pathology for the associated tumor tissue indicated grade 3 adenocarcinoma (Gleason grade 3+3). The tumor perforated and involved periprostatic tissue. There was also perineural invasion, and adenofibromatous hyperplasia was present. The right and left apex were positive for tumor, but the seminal vesicles and mutiple pelvic lymph nodes were negative. Patient history included dysuria, carcinoma in situ of prostate, coronary atherosclerosis, alcohol use, and hyperlipemia. Patient medications included Bactrim. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

PROSNOT05 Library was constructed using 1.1 micrograms of polyA RNA isolated from the prostate tissue removed from a 67-year-old Caucasian male during radical prostatectomy and lymph node biopsy. This library, originally prepared as an unaffected section from the diseased prostate, has been determined to contain some tumor cells. Patient history included coronary artery disease, stomach ulcer, and osteoarthritis. Family history included congestive heart failure in the mother. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

PROSNOT06 Library was constructed using 1 microgram of polyA RNA isolated from the nontumorous prostate tissue of a 57-year-old Caucasian male during radical prostatectomy. The surgery also included removal of both testes and excision of regional lymph nodes. Pathology indicated adenofibromatous hyperplasia. Pathology for the associated tumor tissue indicated adenocarcinoma (Gleason grade 3+3) in both the left and right periphery of the prostate. There was perineural invasion, and the tumor perforated the capsule. A single right pelvic lymph node and the right and left apical surgical margins were positive for tumor, but the seminal vesicles and remaining surgical margins were negative. The testes were unremarkable. Patient history included a benign neoplasm of the large bowel and Type I diabetes. Patient medications included insulin. Family history included a malignant neoplasm of the prostate in the father and Type I diabetes in the mother. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

PROSNOT07 Library was constructed using 0.4 micrograms of polyA RNA isolated from the nontumorous prostate tissue removed from a 69-year-old Caucasian male during a radical prostatectomy. Pathology indicated adenofibromatous hyperplasia. Pathology for the associated tumor tissue indicated adenocarcinoma (Gleason grade 3+4) involving the right side peripherally. The tumor invaded the capsule but did not extend beyond it; perineural invasion was present. The right seminal vesicle was involved with tumor. The remaining surgical margins and lymph nodes were negative. The patient presented with elevated prostate specific antigen (PSA). Patient history included occlusion of a leg vein, diverticuli of the colon, partial colectomy, and tobacco use. Patient medications included Pepcid, multiple vitamins, vitamin C & E, and cod liver oil. Family history included congestive heart failure in the father; benign hypertension in the mother; and benign hypertension, multiple myeloma, hyperlipidemia, and rheumatoid arthritis in the sibling(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

PROSNOT11 Library was constructed using 1 microgram of polyA RNA isolated from the prostate tissue of a 28-year-old Caucasian male, who died from a self-inflicted gunshot wound. The patient had a history of alcohol and tobacco use (1–2 packs of cigarettes per day); otherwise, the medical history and serologies were negative. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSNOT14 Library was constructed using 1 microgram of polyA RNA isolated from prostate tissue removed from a 60-year-old Caucasian male during radical prostatectomy and regional lymph node excision. Pathology indicated adenofibromatous hyperplasia. Pathology for the associated tumor tissue indicated an adenocarcinoma (Gleason grade 3+4) in both the right and left peripheries of the prostate. The tumor perforated the capsule to involve the periprostatic tissue at the left inferior posterior region, and the surgical margin (left apex) was positive for tumor. Perineural invasion was present, and the right and left seminal vesicles were involved. The remaining surgical margins and multiple pelvic lymph nodes were negative. The patient presented with elevated prostate specific antigen (PSA). Patient history included a kidney cyst, hematuria, and alcohol use. Previous surgeries included prostate needle biopsy, adenotonsillectomy, and tendon reattachment. Patient medications included Redoxon (a form of vitamin C). Family history included tuberculosis in the mother; and benign hypertension, cerebrovascular disease, and arteriosclerotic coronary artery disease in the father. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSNOT15 Library was constructed using 0.45 micrograms of polyA RNA isolated from diseased prostate tissue removed from a 66-year-old Caucasian male during radical prostatectomy and regional lymph node excision. Pathology indicated adenofibromatous hyperplasia. Pathology for the associated tumor tissue indicated an adenocarcinoma (Gleason grade 2+3) in the left and right side centrally. The tumor was confined and did not involve the capsule. Perineural invasion was absent, and the right and left seminal vesicles were negative for tumor. Surgical margins and multiple pelvic lymph nodes were also negative for tumor. The patient presented with elevated prostate specific antigen (PSA). Patient history included tobacco abuse in remission and alcohol abuse. Previous surgeries included closed prostatic biopsies, transurethral prostatectomy, and an inguinal hernia repair. The patient was not taking any medications. Family history included prostate cancer and secondary bone cancer in the father; and benign hypertension in the sibling (s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSNOT16 Library was constructed using 1 microgram of polyA RNA isolated from nontumorous prostate tissue removed from a 68-year-old Causcasian male during a radical prostatectormy. Pathology indicated adenofibromatous hyperplasia. Pathology for the associated tumor tissue indicated an adenocarcinoma (Gleason grade 3+4), which perforated the capsule to involve periprostatic tissue in the right superior posterior region. Perineural invasion was present. Surgical margins and multiple lymph nodes were negative for tumor. The patient presented with elevated prostate specific antigen (PSA). During this hospitalization, the patient was diagnosed with myasthenia gravis. Patient history included osteoarthritis, Type II diabetes, tobacco use in remission and alcohol use. Patient medications included Daypro, which was discontinued two weeks before surgery, Prednisone, and Diabeta. Family history included benign hypertension, an acute myocardial infarction, and hyperlipidemia in the mother; and arteriosclerotic coronary artery disease and an acute myocardial infarction in the siblings. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSNOT18 Library was constructed using 1 microgram of polyA RNA isolated from nontumorous prostate tissue removed from a 58-year-old Caucasian male during a radical cystectomy, radical prostatectomy, and gastrostomy. Pathology indicated adenofibromatous hyperplasia; this tissue was associated with a grade 3 transitional cell carcinoma forming an ulcerated infiltrative mass in the left lateral bladder wall. The remaining bladder showed marked cystitis with scattered microscopic foci of transitional cell carcinoma in situ. Surgical margins and lymph nodes were negative for tumor. Patient history included angina, emphysema, and alcohol and tobacco use. Family history included acute myocardial infarction, atherosclerotic coronary artery disease, and Type II diabetes in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSNOT20 Library was constructed using 1 microgram of polyA RNA isolated from nontumorous prostate tissue removed from a 65-year-old Caucasian male during a radical prostatectomy. Pathology indicated adenofibromatous hyperplasia. Pathology for the associated tumor tissue indicated an adenocarcinoma (Gleason grade 2+2) involving the right anterior prostate peripherally. Multiple microscopic foci of tumor were identified in the left and right sides, and perineural invasion was present. The tumor did not involve the capsule. Surgical margins and multiple pelvic lymph nodes were negative for tumor. The patient presented with elevated prostate specific antigen (PSA). Previous surgeries included a transuretheral resection of the prostate. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSNOT26 Library was constructed using 1 microgram of polyA RNA isolated from nontumorous prostate tissue removed from a 65-year-old Caucasian male during a radical prostatectomy. Pathology for the associated tumor tissue indicated an adenocarcinoma (Gleason grade 3+4) forming a predominant mass involving the right and left sides anteriorly. The tumor was confined and did not involve the capsule. Perineural invasion was absent. The right and left apex and right and left bladder base surgical margins were positive for tumor. The remaining surgical margins and lymph nodes were negative for tumor. The patient presented with elevated prostate specific antigen (PSA), post-void dribbling, and a splitting (intermittent) urinary stream. Patient history included benign hypertension, and alcohol and tobacco use. Previous surgeries included a needle biopsy of the prostate and repair of an indirect inguinal hernia. Patient medications included Lopressor, Capoten, and Indocin. Family history included a malignant stomach neoplasm in the father. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSTUT03 Library was constructed using 1 microgram of polyA RNA isolated from the prostate tumor tissue removed from a 67-year-old Caucasian male during radical prostatectomy and lymph node biopsy. Patient history included coronary artery disease, stomach ulcer, and osteoarthritis. Family history included congestive heart failure in the mother. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

PROSTUT04 Library was constructed using 1 microgram of polyA RNA isolated from prostate tumor tissue removed from a 57-year-old Caucasian male during radical prostatectomy. The surgery also included removal of both testes and excision of regional lymph nodes. Pathology indicated adenocarcinoma (Gleason grade 3+3) in both the left and right periphery of the prostate. There was perineural invasion, and the tumor perforated the capsule. Adenofibromatous hyperplasia was also present. A single right pelvic lymph node and the right and left apical surgical margins were positive for tumor, but the seminal vesicles and remaining surgical margins were negative. The testes were unremarkable. Patient history included a benign neoplasm of the large bowel and Type I diabetes. Patient medications included insulin. Family history included a malignant neoplasm of the prostate in the father and Type I diabetes in the mother. cDNA synthesis was initiated using a NotI-oligo (dT) primer. Double-stranded cDNA was blunted, ligated to SalI adaptors, digested with NotI, size-selected, and cloned into the NotI and SalI sites of the pSPORT1 vector.

PROSTUT05 Library was constructed using 1 microgram of polyA RNA isolated from prostate tumor tissue removed from a 69-year-old Caucasian male during a radical prostatectomy. Pathology indicated adenocarcinoma (Gleason grade 3+4) involving the right side peripherally. The tumor invaded the capsule but did not extend beyond it; perineural invasion was present. Adenofibromatous hyperplasia was also present. The right seminal vesicle was involved with tumor. The remaining surgical margins and lymph nodes were negative. The patient presented with elevated prostate specific antigen (PSA). Patient history included occlusion of a leg vein, diverticuli of the colon, partial colectomy, and tobacco use. Patient medications included Pepcid, multiple vitamins, vitamin C & E, and cod liver oil. Family history included congestive heart failure in the father; benign hypertension in the mother; and benign hypertension, multiple myeloma, hyperlipidemia, and rheumatoid arthritis in the sibling(s). cDNA synthesis was initiated using a NotI-oligo (dT) primer. Double-stranded cDNA was blunted, ligated to SalI adaptors, digested with NotI, size-selected, and cloned into the NotI and SalI sites of the pSPORT1 vector.

PROSTUT09 Library was constructed using 1 microgram of polyA RNA isolated from prostate tumor tissue removed from a 66-year-old Caucasian male during a radical prostatectomy, radical cystectomy, and urinary diversion. Pathology indicated grade 3 transitional cell carcinoma located within the prostatic urethra, with extension to periprostatic glands and diffuse invasion to the prostatic parenchyma anteriorly and posteriorly. This tumor was associated with a grade 3 transitional cell carcinoma of the bladder and urethra. In addition, the right prostate contained a microscopic focus of adenocarcinoma (Gleason grade 3+2), which was confined to the prostate and showed no capsular penetration. Surgical margins and multiple pelvic lymph nodes were negative for tumor. The patient presented with prostatic inflammatory disease. Patient history included lung neoplasm, benign hypertension, and tobacco abuse in remission. Previous surgeries included a transurethral prostatectomy. Patient medications included iron supplements and Dyazide. Family history included a malignant breast neoplasm in the mother; tuberculosis in the father; and benign hypertension, cerebrovascular disease, atherosclerotic coronary artery disease and lung cancer in the sibling (s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSTUT10 Library was constructed using 0.9 micrograms of polyA RNA isolated from prostatic tumor tissue removed from a 66-year-old Caucasian male during radical prostatectomy and regional lymph node excision. Pathology indicated an adenocarcinoma (Gleason grade 2+3) in the left and right side centrally. The tumor was confined and did not involve the capsule. Perineural invasion was absent, and the right and left seminal vesicles were negative for tumor. Surgical margins and multiple pelvic lymph nodes were negative for tumor. Adenofibromatous hyperplasia was also present. The patient presented with elevated prostate specific antigen (PSA). Patient history included tobacco abuse in remission and alcohol abuse. Previous surgeries included closed prostatic biopsies, transuretheral prostatectomy, and an inguinal hernia repair. The patient was not taking any medications. Family history included prostate cancer and secondary bone cancer in the father; and benign hypertension in the sibling(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

PROSTUT12 Library was constructed using 1 microgram of polyA RNA isolated from prostate tumor tissue removed from a 65-year-old Caucasian male during a radical prostatectomy. Pathology indicated an adenocarcinoma (Gleason grade 2+2) involving the right anterior prostate peripherally. Multiple microscopic foci of tumor were identified in the left and right sides, and perineural invasion was present. The tumor did not involve the capsule. Surgical margins and multiple pelvic lymph nodes were negative for tumor. Adenofibromatous hyperplasia was also present. The patient presented with elevated prostate specific antigen (PSA). Previous surgeries included a transurethral resection of the prostate. cDNA synthesis was initiated using a NotI-oligo (dT) primer. Double-stranded cDNA was blunted, ligated to EcoRI adaptors, digested with NotI, size-selected, and cloned into the NotI and EcoRI sites of the pINCY vector (Incyte).

RATRNOT02 Library was constructed using 1.5 micrograms of polyA RNA isolated from the right atrium tissue of a 39-year-old Caucasian male, who died from a gunshot wound. Serology was positive for cytomegalovirus (CMV). Patient history included tobacco use (one pack of cigarettes per day for 25 years), and occasionally cocaine, marijuana, and alcohol use. cDNA synthesis .was initiated using a NotI-oligo(dT) primer. Double-stranded cDNA was blunted, ligated to SalI adaptors, digested with NotI, size-selected, and cloned into the NotI and SalI sites of the pSPORT1 vector.

SCORNON02 This normalized spinal cord library was constructed from 3.24 million independent clones from the SCORNOT01 library. Starting RNA was isolated from spinal cord tissue removed from a 71-year-old Caucasian male, who died from respiratory arrest. Patient history included a left bundle branch block, myocardial infarction, gangrene of the right foot, renal failure in end stage renal disease, and confusion. Previous surgeries included a right femoral artery bypass. The library was oligo(dT)-primed, and cDNAs were cloned directionally into the pSPORT1 vectoring system using SalI (5') and Not1 (3'). The normalization and hybridization conditions were adapted from Soares et al., *PNAS* (1994) 91: 9928, except that a longer (24-hour) reannealing hybridization was used.

SCORNOT01 Library was constructed using 2.4 micrograms of polyA RNA isolated from spinal cord tissue removed from a 71-year-old Caucasian male, who died from respiratory arrest. Patient history included a left bundle branch block, myocardial infarction, gangrene of the right foot, renal failure in end stage renal disease, and confusion. Previous surgeries included a right femoral artery bypass. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

SEMVNOT01 Library was constructed using 1 microgram of polyA RNA isolated from nontumorous seminal vesicle tissue removed from a 58-year-old Caucasian male during radical prostatectomy. Pathology indicated the right and left seminal vesicles were negative for tumor. Pathology for the associated tumor tissue indicated adenocarcinoma (Gleason grade 3+2) of the prostate, which formed a predominant mass involving primarily the right side and focally involving the left side, peripherally and anteriorly. The tumor invaded the capsule but did not extend beyond it. Adenofibromatous hyperplasia was also present. Surgical margins and lymph nodes were negative for tumor. The patient presented with elevated prostate specific antigen (PSA). Patient history included tobacco use. Previous surgeries included a. needle biopsy of the prostate. Patient medications included Seldane (terfenadin), Sudafed, and aspirin. Family history included a malignant breast neoplasm in the mother. cDNA was blunted, ligated to EcoRI adaptors, digested with NotI, size-selected, and cloned into the NotI and EcoRI sites of the pINCY vector (Incyte).

SININOT01 Library was constructed using 1 microgram of polyA RNA isolated from ileum tissue removed from the small intestine of a 4-year-old Caucasian female, who died from a closed head injury. Serologies were negative. Patient history included jaundice as a baby. Previous surgeries included a double hernia repair. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

SINTBST01 Library was constructed using 1 microgram of polyA RNA isolated from the ileum tissue of an 18-year-old Caucasian female with irritable bowel syndrome (IBS). The ileum tissue, along with the cecum and appendix, were removed during bowel anastomosis. Pathology indicated Crohn's disease of t he ileum, involving 15 cm of the small bowel. The cecum and appendix were unremarkable, and the margins were uninvolved. The patient presented with abdominal pain and regional enteritis. Patient history included osteoporosis of the vertebra and abnormal blood chemistry. Patient medications included Prilosec (omeprazole), Pentasa (mesalamine), amoxicillin, and multivitamins. Family history included cerebrovascular disease in the mother and a grandparent, and atherosclerotic coronary artery disease in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

SINTFET03 Library was constructed using 1 microgram of polyA RNA isolated from small intestine tissue removed from a Caucasian female fetus, who died at 20 weeks' gestation from fetal demise. Serologies for the fetus were negative. Family history included hypothyroidism in the mother. cDNA synthesis was initiated using a NotI-oligo (dT) primer. Double-stranded cDNA was blunted, ligated to EcoRI adaptors, digested with NotI, size-selected, and cloned into the NotI and EcoRI sites of the pINCY vector (Incyte).

SINTNOT02 Library was constructed using RNA isolated from the small intestine of a 55-year-old Caucasian female, who died from a subarachnoid hemorrhage. Serologies were positive for cytomegalovirus (CMV) but otherwise negative. Patient history included alcohol and tobacco use. Previous surgeries included a hysterectomy. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

SKINBIT01 Library was constructed using 1 microgram of polyA RNA isolated from erythema nodosum tissue from the left lower leg. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

SMCANOT01 Library was constructed using 9 nanograms of polyA RNA isolated from an aortic smooth muscle cell line derived from the explanted heart of a male during a heart transplant. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

SPLNFET01 Library was constructed at Stratagene, using RNA isolated from a pool of fetal spleen tissue. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances.

SPLNFET02 Library was constructed using 1 microgram of polyA RNA isolated from spleen tissue removed from a Caucasian male fetus, who died at 23 weeks' gestation from premature birth. Serology was negative. Family history included diabetes in the mother. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

SPLNNOT04 Library was constructed using 1 microgram of polyA RNA isolated from the spleen tissue of a 2-year-old Hispanic male, who died from cerebral anoxia. Past medical history and serologies were negative. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

STOMNOT01 Library was constructed using RNA isolated from the stomach tissue of a 55-year-old Caucasian male, who died from cardiopulmonary arrest. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

STOMNOT02 Library was constructed using 1 microgram of polyA RNA isolated from nontumorous stomach tissue removed from a 52-year-old Caucasian male during total gastrectomy. Pathology for the associated tumor tissue indicated invasive grade 4 adenocarcinoma with signet ring cell features. The tumor formed an ulcerating 13×7×1 cm lesion involving the gastroesophageal junction. The adenocarcinoma invaded through the muscularis propria into surrounding perigastric adipose tissue. Proximal, distal, and radial resection margins were negative for tumor. Multiple (6 of 18) perigastric lymph nodes contained metastatic adenocarcinoma. Prior to surgery, the patient received Priloseq (omeprazole) to inhibit gastric acid secretion. Patient history included malignant neoplasm of the esophagus, atherosclerosis, and Farmer's lung. Family history included skin cancer in the father. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

STOMTUT01 Library was constructed using 1 microgram of polyA RNA isolated from the stomach tumor tissue of a 52-year-old Caucasian male during total gastrectomy. Pathology indicated invasive grade 4 adenocarcinoma with signet ring cell features. The tumor formed an ulcerating 13×7×1 cm lesion involving the gastroesophageal junction. The adenocarcinoma invaded through the muscularis propria into surrounding perigastric adipose tissue. Proximal, distal, and radial resection margins were negative for tumor. Multiple (6 of 18) perigastric lymph nodes contained metastatic adenocarcinoma. Prior to surgery, the patient received Priloseq (omeprazole) to inhibit gastric acid secretion. Patient history included malignant neoplasm of the esophagus, atherosclerosis, and Farmer's lung. Family history included skin cancer in the father. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

STOMTUT02 Library was constructed using 1 microgram of polyA RNA isolated from stomach tumor tissue removed from a 68-year-old Caucasian female during a partial gastrectomy. Pathology indicated a malignant lymphoma of diffuse large-cell type, forming an ulcerated mass in the posterior stomach wall at the body-antrum junction and involving the full thickness of the gastric wall, including the serosa. The radial, proximal, and distal surgical margins were negative for tumor. The uninvolved stomach tissue showed mild chronic gastritis. Lesser and greater curvature lymph nodes were negative for tumor. Periaortic node was negative for tumor, while the suprapancreatic node was affected by large-cell lymphoma. Transverse mesocolon nodes were identified as four benign matted lymph nodes. The left iliac node region appeared as benign fibroadipose tissue with no lymphoma. Previous surgeries included total hip replacement, vaginal hysterectomy, and cholecystectomy. The patient had a history of thalassemia. Patient medications included Prilosec (omeprazole), zidoxin, Metamucil (psyllium hydrophilic mucilloid), calcium, and vitamins. Family history included acute leukemia in the father, a malignant neoplasm of the esophagus in the mother, a malignant stomanch neoplasm in a grandparent, and atherosclerotic coronary artery disease in a sibling and a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

SYNOOAT01 Library was constructed using 1 microgram of polyA RNA isolated from the knee synovial membrane tissue of an 82-year-old female with osteoarthritis. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

SYNORAB01 Library was constructed using RNA isolated from the synovial membrane tissue of a 68-year-old Caucasian female with rheumatoid arthritis. Patient medications included enteric coated ASA, fluoride 20, fiorinal, iron gluconate, Gold 1 tab, and multivitamins. cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector.

SYNORAT01 Library was constructed using RNA isolated from synovial membrane tissue removed from the elbow of a 51-year-old Asian female with rheumatoid arthritis. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

SYNORAT03 Library was constructed using 1 microgram of polyA RNA isolated from the wrist synovial membrane tissue of a 56-year-old female with rheumatoid arthritis. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

SYNORAT04 Library was constructed using 1 microgram of polyA RNA isolated from the wrist synovial membrane tissue of a 62-year-old female with rheumatoid arthritis. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

SYNORAT05 Library was constructed using 1 microgram of polyA RNA isolated from the knee synovial tissue of a 62-year-old female with rheumatoid arthritis. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

TBLYNOT01 Library was constructed at Stratagene (STR937214), using RNA isolated from a hybrid of T-B lymphoblasts from a leukemic cell line. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances.

TESTNOT01 Library was constructed using RNA isolated from the testicular tissue of a 37-year-old Caucasian male, who died from liver disease. Serologies were negative. Patient history included cirrhosis, jaundice, liver failure, pipe/cigar smoking, flu, and frequent alcohol use. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

TESTNOT03 Library was constructed using polyA RNA isolated from testicular tissue removed from a 37-year-old Caucasian male, who died from liver disease. Serologies were negative. Patient history included cirrhosis, jaundice, liver failure, pipe/cigar smoking, flu, and frequent alcohol use. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

TESTTUT02 Library was constructed using 1 microgram of polyA RNA isolated from testicular tumor removed from a31-year-old Caucasian male during unilateral orchiectomy. Pathology indicated embryonal carcinoma forming a largely necrotic mass involving the entire testicle. Rare foci of residual testicle showed intralobular germ cell neoplasia and tumor was identified at the spermatic cord margin. The patient presented with backache. Patient history included tobacco use. Previous surgeries included a needle biopsy of testis. Patient medications included Colace (docusate sodium) and antacids. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

THP1AZT01 Library was constructed using 1 microgram of polyA RNA isolated from THP-1 promonocyte cells treated for three days with 0.8 micromolar 5-aza-2'-deoxycytidine. THP-1 (ATCC TIB 202) is a human promonocyte line derived from peripheral blood of a 1-year-old Caucasian male with acute monocytic leukemia (ref: *Int. J. Cancer* (1980) 26:171). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

THP1NOB01 Library was constructed using RNA isolated from cultured, unstimulated THP-1 cells. THP-1 (ATCC TIB 202) is a human promonocyte line derived from the peripheral blood of a 1-year-old Caucasian male with acute monocytic leukemia (ref: *Int. J. Cancer* (1980) 26:171). RNA was isolated from 2×108 cells using GUSCN lysis, followed by DNAse treatment. cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector.

THP1NOT01 Library was constructed using 1 microgram of polyA RNA isolated from untreated THP-1 cells. THP-1 (ATCC TIB 202) is a human promonocyte line derived from the peripheral blood of a 1-year-old Caucasian male with acute monocytic leukemia (ref: *Int. J. Cancer* (1980) 26:171). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

THP1NOT03 Library was constructed using 1 microgram of polyA RNA isolated from untreated THP-1 cells. THP-1 (ATCC TIB 202) is a human promonocyte line derived from the peripheral blood of a 1-year-old Caucasian male with acute monocytic leukemia (ref: *Int. J. Cancer* (1980) 26:171). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

THP1PLB01 Library was constructed using RNA isolated from THP-1 cells cultured for 48 hours with 100 ng/ml phorbol ester (PMA), followed by a 4-hour culture in media containing 1 µg/ml LPS. THP-1 (ATCC TIB 202) is a human promonocyte line derived from the peripheral blood of a 1-year-old male with acute monocytic leukemia (ref: *Int. J. Cancer* (1980) 26:171). cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector.

THP1PLB02 Library was constructed by reamplification of THP1PLB01, which was made using RNA isolated from THP-1 cells cultured for 48 hours with 100 ng/ml phorbol ester (PMA), followed by a 4-hour culture in media containing 1 ug/ml LPS. THP-1 (ATCC TIB 202) is a human promonocyte line derived from the peripheral blood of a 1-year-old male with acute monocytic leukemia (ref: *Int. J. Cancer* (1980) 26:171). cDNA synthesis was initiated using a combination of oligo(dT) and random priming. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 1×10e6 primary clones were then amplified to stabilize the library for long-term storage. Amplification may significantly skew sequence abundances.

THP1T7T01 Library was constructed using RNA isolated from 50,000 cultured THP-1 cells, which was amplified using a proprietary T7 amplification method developed at Incyte. THP-1 (ATCC TIB 202) is a human promonocyte line derived from the peripheral blood of a 1-year-old Caucasian male with acute monocytic leukemia (ref: *Int. J. Cancer* (1980) 26:171). Antisense RNA (aRNA) was generated using T7 RNA polymerase following the first round of cDNA synthesis. aRNA was then random-primed to generate double-stranded cDNA, ligated to EcoR1 adaptors, and cloned non-directionally into the pINCY vector (Incyte). The amplification technique used for construction of this library does not significantly skew sequence abundances and can be used for Transcript Imaging purposes.

THYMNOT02 Library was constructed using polyA RNA isolated from thymus tissue removed from a 3-year-old Caucasian male, who died from drowning. Serologies were negative. cDNA synthesis was initiated using an XhoI-oligo (dT) primer. Double-stranded cDNA was blunted, ligated to EcoRI adaptors, digested with XhoI, size-selected, and cloned into the XhoI and EcoRI sites of the Lambda UniZAP vector.

THYMNOT03 Library was constructed using 0.5 micrograms of polyA RNA isolated from thymus tissue removed from a 21-year-old Caucasian male during a thymectomy. Pathology indicated an unremarkable thymus and a benign parathyroid adenoma in the right inferior parathyroid. Patient history included atopic dermatitis, a benign neoplasm of the parathyroid, and tobacco use. Previous surgeries included an operation on the parathyroid gland. Patient medications included multivitamins. Family history included atherosclerotic coronary artery disease in the father and benign hypertension in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

THYRNOT01 Library was constructed using 9 micrograms of polyA RNA isolated from thyroid tissue removed from a 64-year-old Caucasian female, who died from congestive heart failure. Serologies were negative. Patient history included possible Legionella infection, mycoplasma infection, hypotension, emphysema, shortness of breath, dyspnea, othopnea, tobacco use, and pulmonary disease. The patient was not taking any medications. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

THYRNOT02 Library was constructed using 1 microgram of polyA RNA isolated from the diseased thyroid tissue of a 16-year-old Caucasian female with Graves' disease (hyperthyroidism). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

THYRNOT03 Library was constructed using 1 microgram of polyA RNA isolated from thyroid tissue removed from the left thyroid of a 28-year-old Caucasian female during a complete thyroidectomy. Pathology indicated a small nodule of adenomatous hyperplasia was present in the left thyroid. Pathology for the associated tumor tissue indicated dominant follicular adenoma, forming a well-encapsulated mass in the left thyroid. Multiple (2) nodules of adenomatous hyperplasia with degenerative changes were identified in the right thyroid. The patient presented with nontoxic uninodular goiter and dysphagia. Patient history included nonobstetrical galactorrhea, anemia, pure hypercholesterolemia, normal delivery, and alcohol abuse. Previous surgeries included adenotonsillectomy. The patient was not taking any medications. Family history included hyperlipidemia in the mother; hyperlipidemia, skin cancer, and anxiety in the father; and neurotic depression in the sibling(s). cDNA synthesis was initiated using a NotI-oligo (dT) primer. Double-stranded cDNA was blunted, ligated to EcoRI adaptors, digested with NotI, size-selected, and cloned into the NotI and EcoRI sites of the pINCY vector (Incyte).

THYRTUT03 Library was constructed using 1 microgram of polyA RNA isolated from benign thyroid tumor tissue removed from a 17-year-old Caucasian male during a thyroidectomy. Pathology indicated encapsulated follocular adenoma forming a circumscribed mass. Patient history included attention deficit disorder with hyperactivity. Previous surgeries included repair of an indirect inguinal hernia, a needle biopsy of the thyroid, and orchiopexy. The patient was not taking any medications. Family history included benign hypertension, cerebrovascular disease, atherosclerotic coronary artery disease, malignant lung neoplasm, and Type II diabetes in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

TYMNOR01 Library was constructed using RNA isolated from non-adherent peripheral blood mononuclear cells obtained from a 24-year-old Caucasian male. (This is the same RNA source used for TLYMNOT01.) The cells were purified on Ficoll Hypaque, then harvested, lysed in GuSCN, and spun through CsCl to obtain RNA for library construction. cDNA synthesis was initiated using a random primer. Double-stranded cDNA was blunted, ligated to EcoRI adaptors, digested with XhoI, size-selected, and cloned into the XhoI and EcoRI sites of the Lambda UniZAP vector.

TLYMNOT01 Library was constructed using RNA isolated from non-adherent peripheral blood mononuclear cells obtained from a 24-year-old Caucasian male. The cells were purified on Ficoll Hypaque, then harvested, lysed in GuSCN, and spun through CsCl to obtain RNA for library construction. PolyA RNA was isolated using oligo(dT) cellulose. cDNA synthesis was initiated using an XhoI-oligo (dT) primer. Double-stranded cDNA was blunted, ligated to EcoRI adaptors, digested with XhoI, size-selected, and cloned into the XhoI and EcoRI sites of the Lambda UniZAP vector.

TLYMNOT02 Library was constructed using RNA isolated from non-adherent peripheral blood mononuclear cells. The blood was obtained from unrelated male and female donors. Cells from each donor were purified on Ficoll Hypaque, then harvested by centrifugation, lysed in a buffer containing GuSCN, and spun through CsCl to obtain RNA for library construction. PolyA RNA was isolated using a Qiagen Oligotex kit. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

TMLR2DT01 Library was constructed using RNA isolated from non-adherent peripheral blood mononuclear cells. The blood was obtained from unrelated male and female donors. Cells from each donor were purified on Ficoll Hypaque, then co-cultured for 24 hours in medium containing normal human serum at a cell density of 2×106 cells/ml. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

TMLR3DT01 Library was constructed using RNA isolated from non-adherent and adherent peripheral blood mononuclear cells collected from two unrelated Caucasian male donors (25 and 29 years old). Cells from each donor were purified on Ficoll Hypaque, then co-cultured for 96 hours in medium containing normal human serum at a cell density of 2×106 cells/ml. The non-adherent cells were collected, then the adherent cells were collected by scraping with a rubber policeman, and the populations were pooled. The pooled cells were washed once in PBS, lysed in a buffer containing GuSCN, and spun through CsCl to obtain RNA for library construction. PolyA RNA was isolated using a Qiagen Oligotex kit. cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector.

TONGTUT01 Library was constructed using 1 microgram of polyA RNA isolated from tongue tumor tissue removed from a 36-year-old Caucasian male during a hemiglossectomy. Pathology indicated recurrent invasive grade 2 squamous-cell carcinoma, forming a mass 2.5×2×1.3 cm in the right tongue. The margins of the excision and the deep tongue margin were negative for tumor. The patient presented with tongue pain, and a portion of the tongue had been removed earlier. Patient history included tobacco and alcohol use. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

TONSNOT01 Library was constructed using 1.2 micrograms of polyA RNA isolated from the tonsil tissue of a 6-year-old Caucasian male with lymphoid hyperplasia of the tonsils. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

U937NOT01 Library was constructed at Stratagene (STR937207), using RNA isolated from the U937 monocyte-like cell line. This line (ATCC CRL1593) was established by C. Sundstrom and K. Nilsson in 1974 from malignant cells obtained from the pleural effusion of a 37-year-old Caucasian male with diffuse histiocytic lymphoma (ref: *Int. J. Cancer* (1976) 17: 565–577). cDNA synthesis was initiated using an XhoI-oligo(dT) primer. Double-stranded cDNA was blunted, ligated to EcoRI adaptors, digested with XhoI, size-selected, and cloned into the XhoI and EcoRI sites of the Lambda UniZAP vector. Following Lambda UniZAP packaging, 2×10e6 primary clones were then amplified to stabilize the library for long-term storage. Amplification may significantly skew sequence abundances.

UCMCL5T01 Library was constructed using 1 microgram of polyA RNA isolated from mononuclear cells obtained from the umbilical cord blood of 12 individuals. The cells were cultured for 12 days with IL-5 before RNA was obtained from the pooled lysates. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pBluescript vector.

UCMCNOT02 Library was constructed using 1 microgram of polyA RNA isolated from mononuclear cells obtained from the umbilical cord blood of nine individuals. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

UTRSNOT01 Library was constructed using 1.2 micrograms of polyA RNA isolated from the uterine tissue of a 59-year-old female, who died of a myocardial infarction. Patient history included cardiomyopathy, coronary artery disease, previous myocardial infarctions, hypercholesterolemia, hypotension, arthritis, and tobacco use. cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

UTRSNOT02 Library was constructed using 2.5 micrograms of polyA RNA isolated from uterine tissue removed from a 34-year-old Caucasian female during a vaginal hysterectomy. Pathology indicated no diagnostic abnormality. The patient presented with dysmenorrhea, abdominal pain, and dyspareuia. Patient history included mitral valve disorder and hemorrhoids. Previous surgeries included a vaginal delivery and local destruction of an ovarian lesion. The patient was not taking any medications. Family history included stomach cancer in the mother; congenital heart anomaly, irritable bowel syndrome, and ulcerative colitis in the sibling(s); colon cancer in an aunt and uncle; and cerebrovascular disease, Type II diabetes, and depression in the grandparent(s). cDNA synthesis was initiated using a NotI-oligo(dT) primer. Double-stranded cDNA was blunted, ligated to SalI adaptors, digested with NotI, size-selected, and cloned into the NotI and SalI sites of the pSPORT1 vector.

UTRSNOT05 Library was constructed using 0.945 micrograms of polyA RNA isolated from the uterine tissue of a 45-year-old Caucasian female during a total abdominal hysterectomy and total colectomy. This nontumorous tissue was associated with multiple leiomyomas of the myometrium and a grade 2 colonic adenocarcinoma of the cecum. Patient history included multiple sclerosis and mitral valve disorder. Previous surgeries included a polypectomy. Patient medications included Tagamet and iron supplements. Family history included Type I diabetes in the mother; cerebrovascular disease, atherosclerotic coronary artery disease and malignant skin neoplasm in the father; hypertension in a sibling, and atherosclerotic coronary artery disease and malignant neoplasm of the colon in a grandparent. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

UTRSNOT06 Library was constructed using 0.56 micrograms of polyA RNA isolated from nontumorous myometrial tissue removed from a 50-year-old Caucasian female during a vaginal hysterectomy for suspected uterine cancer. Pathology indicated residual atypical complex endometrial hyperplasia. Pathology for the associated tissue removed during a D&C indicated fragments of atypical complex hyperplasia and a single microscopic focus suspicious for grade 1 adenocarcinoma. Patient history included a benign breast neoplasm, hypothyroid disease, arthralgia, and tobacco use. The patient has a previous polypectomy. Patient medications included Synthroid for hypothyroidism and Excedrin. Family history included cerebrovascular disease in the mother, atherosclerotic coronary artery disease in a grandparent, and hyperlipidemia and chronic hepatitis in a sibling. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

UTRSNOT08 Library was constructed using 1 microgram of polyA RNA isolated from the uterine tissue removed from a 35-year-old Caucasian female during a vaginal hysterectomy with a dilation and curettage. Pathology indicated that the endometrium was secretory phase with a benign endometrial polyp 1 cm in diameter. The cervix showed mild chronic cervicitis and the myometrium was unremarkable. The left ovary biopsy was negative for endometrius. A portion of a hemorrhagic corpus luteum was present. The patient presented with abdominal pain. Patient history included hypothyroidism. Patient medications included Prozac (fluoxetine hydrochoride) and Synthroid (levothyroxine sodium). Family history included atherosclerotic coronary artery disease and Type II diabetes in a grandfather. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

UTRSNOT10 Library was constructed using 7.5 nanograms of polyA RNA isolated from nontumorous uterine tissue removed from a 50-year-old Arabian female during a total abdominal hysterectomy and sigmoidectomy. Pathology indicated multiple (2) leiomyomata and atrophic endometrium. The cervix and fallopian tube were unremarkable. The right ovary showed a corpus luteum. Pathology for the associated tumor tissue indicated an invasive grade 2 adenocarcinoma situated in the rectosigmoid colon and ding through the muscularis propria into the pericolonic tissue. The radial margin and multiple regional lymph nodes were negative for tumor. Patient history included of deficiency anemia, anxiety, asthma, a normal delivery, and tobacco use. Previous surgeries included a laparoscopic cholecystectomy and removal of a single ovary and tube. Patient medications included Co-Proxamol. cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

UTRSNOT11 Library was constructed using 7.5 nanograms of polyA RNA isolated from uterine myometrial tissue removed from a 43-year-old female during a vaginal hysterectomy and salpingo-oopherectomy (removal of fallopian tubes and ovaries). Pathology indicated the myometrium contained an intramural and a submucosal leiomyoma. The endometrium was in proliferative phase. The cervix and fallopian tubes were unremarkable. The right and left ovaries contained corpus lutea. The patient presented with metrorrhagia and deficiency anemia. Patient history included depressive disorder, irritable colon, and an unspecified stomach disease. Patient medications included Provera, iron, and vitamins. Family history included benign hypertension, hyperlipidemia, colon cancer, and Type II diabetes in the father; colon cancer in the mother, and atherosclerotic coronary artery disease and colon cancer in the grandparent(s). cDNA synthesis was initiated using a NotI-oligo(dT) primer. Double-stranded cDNA was blunted, ligated to EcoRI adaptors, digested with NotI, size-selected, and cloned into the NotI and EcoRI sites of the pINCY vector (Incyte).

SEQUENCE LISTING (1490 sequences)

SEQ ID NO: 1 - DNA, 304 bp; single-stranded, linear
  immediate source library: U937NOT01
  immediate source clone: 000504
ggagaacagattgcaagggagcatggtnttaggttttttgngnactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaacctctaacagatatttttntttctaa

SEQ ID NO: 2 - DNA, 672 bp; single-stranded, linear
  immediate source library: U937NOT01
  immediate source clone: 001705
gctgggaggcgcggccggccacgctcgagcttagggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggntctggcgtctcctctctaggatcgaagagcagncataaaaccacaaagtcaacgcaaacacaagactcttcatttcagggactgatacttgaaaaggatccaacaggaatgtaccttggggatttggaaattagaaaancctnacatctatgaaggcaggatnagagaaaaangcaggataaaangggaagtttncagatagtttcaanccacccacaaaaaaaatcccccactntcgaaaannaaggcatnnanaatncttgaattnganccaaanattccagcccaacgtcaagnngcttatttaggcaacaagatncttccccnggnggnacatccaccaccc

SEQ ID NO: 3 - DNA, 381 bp; single-stranded, linear
  immediate source library: HMC1NOT01
  immediate source clone: 003803
gcattgtgggaaagcattcatatctgccaagatcgtttgaatacatgcaaaacacacactggagagaaacctatgaatgtaaggaatgcaaacaagcattcaattatttttcttccttgcatatacatgaaaggactcatacgagagagaatccgtatgaatgtaaggattgtgggaaagcattcagcttgcttaattgctttcatagncatgtaaaggcacaccagaaggaaccctatggatgtaagcaatgtggcaaangctttcacttcttccagttcttttcaatatcatgnaaggnctcacactggggagnaaccgtattcaattgtaagcaatgtggggaaagccgtcagatccagcctnaaggccttcaaatgc

SEQ ID NO: 4 - DNA, 334 bp; single-stranded, linear
  immediate source library: HMC1NOT01
  immediate source clone: 008915
attccatcgagtactgtctgggatgcatctccaacaccgnctcctacctgaggctctgggggcttagctggatcacgcacagttgtctgatgtcctgtgggccatgctgatgcgcnnggggcctccgnnttgacancacctanggcggncttgctacttntccccgnttnatcgnggntcttttcaagntttnnnccattttncatcctttctnantcaatggaagggntttctngcgnttttttaacgncaananggccttccactgggtnngaatttcaagancaaantnctacgnttggtgcaaggaacccaaaattttgttnccctttct

SEQ ID NO: 5 - DNA, 1253 bp; single-stranded, linear
  immediate source library: THP1PLB01
  immediate source clone: 010773
gncgctaacgggcttgantcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaaggtttgtattaaaagggataaatagtaaa

SEQ ID NO: 6 - DNA, 872 bp; single-stranded, linear
  immediate source library: THP1PLB01
  immediate source clone: 011615
gtcgggagctgacgtggacagctcatcaccggntgctggaggtacgaggatgtcgtccaggaaagattgtgcagatgactgaagcagaagttcgaggcttatgtatcaagtctcgggagtatctttctcagccagcctattctnngggaattggaagcaccgctgaaaatnngnggagatattcatggacagtatacagatttactgagattatttgaatatggaggtttcccaccagaagccaactatcttttcttaggagattatgtggacagaggaaagcagtctnnggaaaccanctgnttgctattggnttataaaatcaaatatccagagaacttctttctcttaagaggaaaccatgagtgngctagcatcaatcgcatttatggnttctatgatgaatgcaaacgaagatttactatnanatngtggaagacccccactgattgttttaactgtctgnctatagcagacattgtggatgagangatcttctgtcgtcatggnggatgccaccagacctgcaatctatggaggagattcggagattatganacctctgangtcccgatcaggttgntcaggtctaagatgtcganagagggagccgcactgantnnttcctncncnggacgctggcatcaattncgncccaccccngataacnaacnccnantatctcatccttngcanggagnnatnntctcacantccccgccncncccntggngattgccccncccgtnccnnagctntnnnnnccctttcccntgnnnacctctccccccccctanacgtctccngnanctccccnnccccntnccaattcccccnccgctgcntcccctccccnaacaccccccaccntn

SEQ ID NO: 7 - DNA, 296 bp; single-stranded, linear
  immediate source library: THP1PLB01
  immediate source clone: 013353
gaacaacccaggcagaggggaatgcgttttagatacaaatntgaagggcgntcagcaggcagcattccaggggagcacagcacagacaacaaccgaacatacccttntntccagattatgaactattatggaaaaggaaaagtgaggattacattngtaacanagnnatgncccatntaaacctcaacctcatgatttanttggaaaagacttcagngncgggttacttttaagcaganttttggcaagaccgcaggaccttttttttttnccaaaanttnggnattccgatgttc

SEQ ID NO: 8 - DNA, 342 bp; single-stranded, linear
  immediate source library: THP1PLB01
  immediate source clone: 014309
agccagagcaccatctgcaggttcgagtccctcacactgtcccacaataatatgatcgcnctcaaacccatcctgcaggcatggntcgaggaggccgagaagtcccaccgcgagaagctcaccaagcctgaactcttcaatggcgcggagaagaagcgcaangnacgtccatcgctgcgccananaagcgctcgctcgnagcctactttgccattcagccttggncctcctctnaaaagatcnccgccatcgnggagaaagttggaccttaagaaaancgtggtgcgcgtctggttnttcaaccaanaggcaagaaacagnaaaagaattnaatttttnttg

SEQ ID NO: 9 - DNA, 619 bp; single-stranded, linear
  immediate source library: THP1PLB01
  immediate source clone: 014360
cttcatatttctatcataatccctgggggtaagaaatcatatagtcccaggttgggaaggggaaaaacggtttgcaacatcctcctccttgtaggaggcgagctctgtctcactagctatgcccctccatcaattcaccctatactcagatcagaagctgagtgtctgaattacagtatattttctaaattcctagcccctgctggtgaatttgccctcccccgctcctttgacaattgtccccgtgttcgtctccgggccctgagactggccctgcttatcttgctgaccttcatcctctgctggacaccttattacctactgggtatgtggtactggttctcccccaccatgctaactgaagtccctcccagcctgagccacatccttttcctcttgggcctcctcaatgctcctttggatcctctcctctatggggccttcacccttggctgccgaagagggcaccaagaacttagtatagactcttctaaagaagggtctgggagaatgctccaagaggagattcatgcctttagacagctggaagtacaaaaaactgtgacatcaagaagggcaggagaaacaaaaggcatttctataacatctatttgatcct

SEQ ID NO: 10 - DNA, 714 bp; single-stranded, linear
  immediate source library: HUVELPB01
  immediate source clone: 016624
cgcgtccgcctggtctactgggttctgcttttcnagactcctgccctttccaaaaggaanacggtatgattaagttccaggaaagggtgacattcaaggatgtggctgttgtcttcaccaaggaananctggcactattggataaagcccagataaacctgtaccaagnatgtgatgctggaaaacttcaggaacctcatgttagtgagagacgggattaaaaacaacattttgaatcttcaggcaaaggggttaagttacctttcgcaaggaagtgcttcattgctggcaggatttggaaacaaaggatccgggatttaactgtgagtcaggattatatcgtgaaccttcaagaananttgttccccacatttagaagatgtttccctcaggtgaaanaattgggcaggcatttctccttcngatttcttgaaaatgaaaactatgtttgttaaatgccattatcaaaaatcaagaatatcncagccatggcaaaagccttgacacagggttccttacccccaaaaatcgttggaagaaaagccnacattattgaacccgaacccccagaaacncttcgngggaaagaatntttgggggaaattttaccntggaaaagaaaaaaatttgttccnaacttgctccacccatgaatgaacaccccccnnttngaaccccctttnaancatncatgaattccccnagaaatgntgg

SEQ ID NO: 11 - DNA, 1181 bp; single-stranded, linear
  immediate source library: ADENINB01
  immediate source clone: 020293
cctgggtgaggntccggcacgaggagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttccctcatccctgctctggattttagtttgggtgcttagttaaatcttttccaggaaaaagaacttccccatacaaataagcatgagactatgtaaaaataaccttgcagaagctgatgggggaaactcaagcttcttcactcacagcaccctatatacacttggggtgtgcattcttattcatcagggaggaagtttctttgaaaatagttattcaagttataagtaatacagagattatttgattatatacttgttgtttaatgtttaaaatttcttagaaaacaatggaatgagaatttaagcctcaaatttgaacatgtggcttgaattaagaagaaaattatggcatatattaaaagcaggcttcctatgaaagactccaaaanctgcctgggaggcagatggaacttgagcctgtcaagaggcaaaggaatcccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtggggggcggggccggggggactctggtatctaattctttaatgattcctataaatctaatgacattcaataaagttgagcaaacattttactt

SEQ ID NO: 12 - DNA, 249 bp; single-stranded, linear
  immediate source library: ADENINB01
  immediate source clone: 022878
ccagagaagtcatactggagagaaaccttacaaatgcaatgaatgtggcaaggtcttcagtcagacttcacatcttgtggggcatcggngaattcatactggagagaaaccttacaaatgtgataaatgtggtaaagcctttaaacagggctcattactcactcgacataagataattcataccagngagaaacgttaccaatgcggtgnatgtggntnggtcttttngtgaaattttcattnctttgt

SEQ ID NO: 13 - DNA, 233 bp; single-stranded, linear
  immediate source library: ADENINB01
  immediate source clone: 024266
agtagcaataatttattaacaaaatattgaaaggaatattttcccctttaatttgatagataattcctgagaacttcagtgttttcagtttgatccgggaaatgcggacacagaggccttcattagttcaaacgcaggtatgaactatagtgaatggntcagaacatgtgtctgagtcttgctccatctgtttaatggtgaggcatccaaaaacagctgactgctcagatatt

SEQ ID NO: 14 - DNA, 319 bp; single-stranded, linear
  immediate source library: SPLNFET01
  immediate source clone: 026841
gcaaagctttcacttcttccagttcttttcaatatcatgaaagancacactagggagaaaccctatcaatgtaagcaatgtgcaaaagcctttatttcttccacttcttttcaatatcatgaaaggactcacatgggagagaaaccctatgagtgtatgccaagtgggaaagccttcatttcttctagttcccntcaatatcatgaaaggnctcacactggagagaagccctatggntataagcaatgtggggangccttcagatcagccttgcaccttcaaatgcatggaagggcctcacactngggnaaaacccntt

SEQ ID NO: 15 - DNA, 345 bp; single-stranded, linear
  immediate source library: SPLNFET01
  immediate source clone: 026879
gggtccatgtcttactcagagagagaaaaaaacatgcacagcttcaacacggatccagaggtgtttatctncttagtgagtacacgagctggtggcctgggcattaatctgactgcagcagatacagttatcatttatgatagtgattggaacccccagtcggatcttcaggcccaggctagatgtcatagaattggtcagacaaagccagttgttgtttatcgccttgtacagcaaatactatcgatcagaaaattttggaaagagcagcttcctaaaaggnaaacttggaaaantttnntcatccatnaaaantcatttcaaanggtggtcaagtctttttnc

SEQ ID NO: 16 - DNA, 291 bp; single-stranded, linear
  immediate source library: SPLNFET01
  immediate source clone: 027044
gcccaaatgcagggagaagagtcgcttgacttgaagagaagacggattcaccaatgtaactttgcaggatgcagcaaagtgtacaccaaaagctctcacctgaaagctcaccgcagaatccatacaggagagaagccttataaatgcacctggnatggctgctcctggaaatttgctcgctcagatgagctcactcgccatttccgcaagcacacaggcatcaagccttttcggtgcacagactgcaaccgcagcttttctcgttctgnccacctgtccctgcatngggct

SEQ ID NO: 17 - DNA, 314 bp; single-stranded, linear
  immediate source library: SPLNFET01
  immediate source clone: 027099
taaggccttatgagtgcagtgaatgtggaaaattgtttagtttcaactccagcctcatgaaacatcagagagttcacactggagaaagaccttataagtgcagtgaatgtggaaaattctatagccacaagtccanccttatcaancattggcgtgttcanactggagaaaggccttannagtgcagngantgtgggaaattttttanccnnagctcaagcctcatncaacatcgaaaagttcacactggagaaaagccttttaagtgcaatgnatgtgggagattctttagtgagaattccagccttttttat

SEQ ID NO: 18 - DNA, 831 bp; single-stranded, linear
  immediate source library: SPLNFET01
  immediate source clone: 027211
aggcncggnttctctctanatgctggtgtnngnccggnccccaantnaatgattttntttttctncngcctccntccnccgggttcagntggagtctccngcctcagcctcccgagtagctgcgactacagacatccttcaaagttganccctttttttccgctgtgagtctctacacatgtntganactctcatgtnccacgggattacagaaaaanattccttgcaggganaaaatgggttcccnctganntggggaananngaanctgatttcccgggntgaaaatnggngaancacaaatntaccccctttcgtttaaaacaaaanaanggggtggccngtggaaaaanatttttttnttggngcaccccatcctcaaaacaaagggattcccncncagggggnccagaaaaattcanccctcccaggggttaacagcccctgaactccgaanggctcccgttcagcgcttcaggcagttttgctaccaggaggtnactggcccacatgaagcttttagcaaactctgggaactctgttgtcagtggctgaggccgaaanacccactcnaaagangaaatcctgganctgctggttttggagcantttctgactatcttgccagaagacatccagacctgggtgaaggagcagcatccagaaaaacngcgaagaactgtggctctggttgaagatttncagaaactcctgganaacagttctanaatctgaaaaggattgaaattnccntgaaagaaanngccctttnggancnaccaaaaatcctgaattcccatggaaacaggagtcaccaaagaaccacttttc

SEQ ID NO: 19 - DNA, 962 bp; single-stranded, linear
  immediate source library: SPLNFET01
  immediate source clone: 027244
gaccacgcgtccgcgatggntctgatctccagggtagaagtggcaacagagtaagncagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagnttngntaccaggaggtaactggcccacatgaagcttttagcaanctctgggaactctgttgtcagtggctgaggccgaagacccactcaaaagaggaaatcctggagctgntggtttgggngcagtttctgantntcttgccagaggagatccagacctgggtgagggagcagnatccagaaaacggggaggaagctgtggntctggttgaggatgtacagagagctcctggacaacagcctgggttgntcctcaggctcccaggaacctgcctcaaaacacaggtctccacgaccaggagacaggtgctgtggnctggacagntggctcccaggntagagtggtgctattttntcgcgtngcagcagctccagtgtttgttacagnggancagcantgcgttnaaaacagagtttnctccctctgtcaannaanaattngntgtgcccagcccctnaaacaatgggcccnntacaggggtgncacccacganggaaggacaagtcacntctcgctggcaacaggtgtcccctgnggtattgaangagaccacccgctcctnggttttncttngtngttctcaattttnttggaanctccanacctnnnanaagaacaagccatntttcagggccntgtgnnangctttttcgagtaggttttntntcgtcccacanagntcgcccaatccatatctangntgtnnccccaatgtnaggggnncnccccttcccctntttttttgangaatantctcttcacn

SEQ ID NO: 20 - DNA, 712 bp; single-stranded, linear
  immediate source library: SPLNFET01
  immediate source clone: 029167
tcttgtgnntcctcnctcannnagcggcggctgcggctctggcggcaaaaaacttccanttgtgcttctcgcaggtcaagggggccatcgacgaggtacntggccgaagcggacatcatttccaccgttgcagtttaattactctggnagatcttcttgcaacaggagacaagggcggcagagttgttatttttcagcgtgaacaaganaataaaagccgccctcattctaggggagaatataatgtttacagcacctttcaaagtcatgaaccggagtttgactatttgaaaagtctagaaattgaggaaaaaattaataaaattaggtggttaccacaananaatgctgctcattttctactgtctacnaatgataaaactataaaattatagaaaataagtgaacgggataaaagagcanaaggttataacntgaaanacnaanatngaagacttcgagacccatttaggatcacggcgctacgggtcccaatattgaagcccatggatcttatggtagaagccaatccccggccaatttttgcnaatgctcccccctatcatataaattccatttcagtaaatagtgatcatgaaacatatctttctgcngatnacctganaattaatttatggcncttagaaatccccgatngaagctttaacatcgtggacatcaacctgctaacntggaagaactgaangaantt

SEQ ID NO: 21 - DNA, 693 bp; single-stranded, linear
  immediate source library: SPLNFET01
  immediate source clone: 029592
gcagggctcacattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaacta

SEQ ID NO: 22 - DNA, 918 bp; single-stranded, linear
  immediate source library: THP1NOB01
  immediate source clone: 030443
ggcacctgcccctgggctgggacagcccactgttccatgctgcccaagaaggctcagcacaggcacaaaccattgcccggcactggcccgtgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagccatgcgagcggctggaactctgctggccttctgctgcctggtcttgagcaccactgggggcccttccccagatacttgttcccaggaccttaactcacgtgtgaagccaggatttcctaaaacaataaagaccaatgacccaggagtcctccaagcagccagatacagtgttgaaaagttcaacaactgcacgaacgacatgttcttgttcaaggagtcccgcatcacaagggccctagttcagatagtgaaaggcctgaaatatatgctggaggtggaaattggcagaactacctgcaagaaaaaccagcacctgcgtctggatgactgtgacttccaaaccaaccacaccttgaagcagactctgagctgctactctgaagtctgggtcgtgccctgggttccagcacttcgaggtgcctgttctccgttgtcactgacccccgcctcttcagcaagaccacagccatgacaaacaccaggatgcatgctccttgtcccctcccacccgcctcatgacccagcctcacagaccctctcaggcctctgacgagtgagcgggtgaagtgccactgggtcaccgcaggcagctggaatggcagcatggtagacgccttctaacagnttaaatagatcacatttgcttntaaaatt

SEQ ID NO: 23 - DNA, 293 bp; single-stranded, linear
  immediate source library: THP1NOB01
  immediate source clone: 032020
cttaagctcccactcaacacttattattcacgagcgaattcatactggagaaaaaccatgtaaatgtaaagtatgtggaaaagccttcagacagagttccgctctcattcaacatcagagaatgcatactggagaaagaccctataaatgtaacgagtgtgggaaaacattcaggtgtaactcatcacttagtaatcaccagngaattcatactggagggnaaccatatcgntgtgaggaatgtggggtatcttttggccaaagttcagctcttattcagnatcgaaggnttc

SEQ ID NO: 24 - DNA, 875 bp; single-stranded, linear
  immediate source library: THP1NOB01
  immediate source clone: 033273
ntttcccgctctgtnaggccccggttganaccgccatacttctgtcgccctgtcgtctgtgttgtgactgcttnggacgtgggagtcacctgaaagccaggaaatggacttggtggctttcgaggatgtggctgtgaacttcacccaggaggagtggtctttgctggatccttcccagaagaatcccttcagagaagtgatgcaggaaaccttgaggaatctggcctccataggagaaaaatggaaagaccagaacattgaagatcagtacaaanntcccaggaataatctaagaagtcttctgggagagagagtcgatgaaaatacagaagaaantcattgtggagaaacttctagccagattccagatgacacactgaacaaaaaaactnctcctggagtaaaatcatgtnaaagcagcgtntntngagaagtctncgtggntcancctcccctcaataggnacatnagngctgacactncacanannccctctnactntcancantntggacaggagccatttangtgtcaacaacgtccagcatagcctccagatgccancccttcttttcaaatcnaacaaaacngctcacactggcngnancanctctatgattgcaaccgaactcngataanacccncnacnttcccactccaanctattcaacncnacatncctanttncaaaactcngncttcnctntttacttcantcttnnttctngggcgnanagccctnccctccgcttcanctntatctctttnnnnatcctcnntttccacactnccgantcancccttttcttccnacnactcncgtacnccnnctgccantcnanncccccccancttcaacactncccccccctgcn

SEQ ID NO: 25 - DNA, 226 bp; single-stranded, linear
  immediate source library: THP1NOB01
  immediate source clone: 033760
ggnccttcccctgtncacaatgcgacaaggcctatggnacccagcgagacctcaaagagcaccaggtggtacattcaggtgnccggccctttgcttgtnaccagtgtggcaaggcctttgcccgccggccctccntgcggctgcatcgcaagacccaccaggtgccagctgcccctgccccttgnccatgncctgtgtgtgggcggncnctggcaaccagggcttc

SEQ ID NO: 26 - DNA, 320 bp; single-stranded, linear
  immediate source library: THP1NOB01
  immediate source clone: 033849
catctgcagtgggttcttccgtaatgctgccaagaaagacccgcagagggttaccggacactgntcgaccagcaggnggtctatatccatccttccagtgccctcttcaanagacagccagaatgggtggtgtaccatgagctggtgctcaccaccaaggaatacatgcgtgaagttaccaccatngancctcggtggcttgtggagtttnccccagccttttttaaggtnttagacccanctaaggtnngnaaacagangangcaacagngttttgaaccccttgttcaacccgttntngggacccaatttcctngggg

SEQ ID NO: 27 - DNA, 214 bp; single-stranded, linear
  immediate source library: HUVENOB01
  immediate source clone: 035379
cttcagtggctcctctgacaagaccatcaaggtgtgggacacatgtaccacctacaagtntnagaagacactggagggccatgatggcatcgtgctggctctctgcatccaggggtgcaaactctacagcggctctgcagactgcaccatnattgtgtgggacatccagaacctgcagaaggtntacaccatccgggcccntnaaaacccggtt

SEQ ID NO: 28 - DNA, 234 bp; single-stranded, linear
  immediate source library: HUVENOB01
  immediate source clone: 039043
cttcggtctggnagccaggatagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttntaggtgcataaggggagcaaggtatacaatgccgtc

SEQ ID NO: 29 - DNA, 1589 bp; single-stranded, linear
  immediate source library: HUVENOB01
  immediate source clone: 039200
gctcaatttgaaagctataaagcgttaacagccagtgagatagaagatcttaagctggagaactcatcattacaggaaaaagtggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatctaaccctgctc

SEQ ID NO: 30 - DNA, 262 bp; single-stranded, linear
  immediate source library: TBLYNOT01
  immediate source clone: 040194
aaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggnatccgaatgttggatgtactggaatatatacatgaaaatgaatatgttcatggtgatataaaagcagcaaatctacttttgggttacaaaaatcctt

SEQ ID NO: 31 - DNA, 245 bp; single-stranded, linear
  immediate source library: TBLYNOT01
  immediate source clone: 040601
gataaatccctggctactagaactgaccaggacagcagaactgcattgcactgggcatgctcagctggacatacagaaattnttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcanaatggctgtactccctt

SEQ ID NO: 32 - DNA, 391 bp; single-stranded, linear
  immediate source library: TBLYNOT01
  immediate source clone: 041879
agacgatcttgcctcttactggcctacaaaataaaatatcctgagaatttttttcttctcagagggaaccatgaatgtgccagcatcaacagaatttatggactntatgantgaatgnaaacgnaagatnnaacattaaactntggaanacnttcacngantgttttaactgtttnccnatagcagccatngtggatgagaagatnttctgntgtcatggaggtttgtcaccagacctgcaatctatggagcagattcggagaattatgagacctactgatgtccctganacaggtttgcnctgtgatttgctatggtctgatccngataaggatgtgcaaggctggggagaaaatnatcgtggngtttcctttncntttggagctgatgt

SEQ ID NO: 33 - DNA, 731 bp; single-stranded, linear
  immediate source library: CORNNOT01
  immediate source clone: 046081
tcttttcgaccccgcttccctttataaggagcggnaacatctccccntcaccaanttnggngccgccgacattcagaggggcaggacacgggaacgcncnctgtcttgatttacggcgcgggtgcgcgagtttgnggnagngtgacgccctcaagtttnggngggaaaagcgctgcatttggattcctgcagtggtgggcaaaggacagtccgccgaggtgctcggtggagtcatggnagtgccctttgtggaagactgggacttggtgcaaaccctgggagaaggtgcctatggagaagttcaacttgaagaagcagtcgcagtgaagattgtngatntgaagcgtgccgnagactntccagaaaatattaagaaagagatctttntcaataaaatgctaaatcatgaaaatgtagtaaaattctatngtcacaggagagaaggcaatatccaatatttatttctggagtactgtagtggaggagagcttttttgacagaatagagccagacataggcatgctnaaccagatgctcagagattcttccatcaactcatgggaggggtgggttatcttgcatggtatnggnataactcacagggatattaanccagaaantcttcttttgggttnaaagggatancctcacatctcagactttggcttggnacagcntttcgctttnttacctnaccgntggngacanaatttctnnnnttcccctntttc

SEQ ID NO: 34 - DNA, 207 bp; single-stranded, linear
  immediate source library: FIBRNOT01
  immediate source clone: 053078
tnacagtntcccagcccggtctgtcgacctttactgcacagctgccagcgccacagcccctggcctcatccgcagccanagcacagccagtgggcaaggcgaaaaaaagccttatgagtgcactctctgcaacaagactttnaccgncaaacagaactacgtnaagcacatnttcgtncacacaggtgagangccccancanttttt

SEQ ID NO: 35 - DNA, 243 bp; single-stranded, linear
  immediate source library: FIBRNOT01
  immediate source clone: 054065
gttgacatctggtccctgggcatnatggccatcgaaatgattgaaggggagcctncatacctcaatgaaaaccctntgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaat

SEQ ID NO: 36 - DNA, 216 bp; single-stranded, linear
  immediate source library: FIBRNOT01
  immediate source clone: 054312
ctaaaanttttcaaaccaacaaacccctgagaacaaaantgaacgaaantttattctcctctttcattaccccaaccctaataggnttacctattattnttnttattattatatttccacttgtcattatgacatcatcaaaacgcttagtaaacantcgatttcacaccttccaacagtgattaattaaactaattactaagcaaataatagcat

SEQ ID NO: 37 - DNA, 165 bp; single-stranded, linear
  immediate source library: FIBRNOT01
  immediate source clone: 054329
gnagggnaaaccagagaagccacctacaaagaaatcaaagaagcctgntcatgaccaggnccctnttgatgccctctcacaagatttggacagctgcccctcaactacagaganctcncagcatacaggaanggagaagngcaagaagatnggttcaaattccaa

SEQ ID NO: 38 - DNA, 1398 bp; single-stranded, linear
  immediate source library: FIBRNOT01
  immediate source clone: 056494
cgggagctgggcagggggaaatttgcagtggctgacaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcaaacagagaagatgcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctytcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccgaggaatccattgtaaccgaagagttaattgtagttacttcatatactctaggacaatgcagacagtctgaaaaagagaaaatggagcaaaaggccatttcccaaacgatttaaatttgaggaacctttgcctacaagaaattccaggagaatttatctactgagcaatatttccctttagaacttcaagatttctacactgaaaatgttaatattatttatggacctctggccaaatggtacatgtactggaagtggataaccagtatcacttacacaaacaaaaataactttgtcaaatttgtggagttaggtggaagccagattttaaaagttgccaaccaggatatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactac

SEQ ID NO: 39 - DNA, 269 bp; single-stranded, linear
  immediate source library: PLACNOB01
  immediate source clone: 063010
gtgggaagtcctttaatcgtagctcaaaccttgttcaacatcagagtattcattctggtgtaaaaccatatgantgtaaggngtgtgggaaaggctttaatcgtggtgcacaccttattcagcatcagaaaattcattccaatgagaaaccctttgtatgtaaggantgtgggatggcctttngatatcattaccaacttattgaacattgccaaattcatactggtgagaaaccctttgantgtaaagaatgtggnaaggcgtttact

SEQ ID NO: 40 - DNA, 237 bp; single-stranded, linear
  immediate source library: PLACNOB01
  immediate source clone: 065020
gaggtcgcaaagttcctcacagtttaggtctcaaggcaagcctattgagttaacacctctnccgctgctaaaagacgttccatcctcagagcagcctgaactgttcctaaagaaacttcagcagtgctgtgtcatttttnacttcatggacacgctatctgatcttaaaatgaaagaatacaagcnctccactcttaatgaactggtggactacattacaataagcagaggctgttt

SEQ ID NO: 41 - DNA, 187 bp; single-stranded, linear
  immediate source library: HUVESTB01
  immediate source clone: 068399
tntgtacggggggtaagcggaggaaagacgagatcagtgtggacagtctggacttcaacaagangatcctgcacacagcctggcaccccgtggacaatgtcattgccgtggctgccaccaataacttgtacatattccaggncaaantcaactagngacgcgaacgtgaggnccaagtcttgtnttg

SEQ ID NO: 42 - DNA, 185 bp; single-stranded, linear
  immediate source library: SYNORAB01
  immediate source clone: 077546
tgcnacgatgacagatacaaattcgcagataataaatggtctgtgacgggcaaagctgagcccgccatgcctggncgcctgtacgtgcacccagactcccccgccaccggggcgcattggatgaggcagctcgtctccttccagaaactcaagctcaccaacaaccacctggacccatttgggca

SEQ ID NO: 43 - DNA, 754 bp; single-stranded, linear
  immediate source library: SYNORAB01
  immediate source clone: 077736
ggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggccaggagggaacaggagcctgagccagggcaatggccctgccaccctggaggcacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagc

SEQ ID NO: 44 - DNA, 1539 bp; single-stranded, linear
  immediate source library: HYPONOB01
  immediate source clone: 084476
aattcggcacgagggaaaggagaggaaggggggggcaagccctcacctgcgccaatcagggtttgaaactgttacaatatggctttcctgggactcttctctttgctggttctgcagagtatggctacaggggccactttccctgaggaagccattgttgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttnatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaagatcaaatttgacagcctctctgataataaggagatttttctttccaaagcaattcacaagtccttcctagaggttaatgaagaaggctcagaactctctgtctcaggaatgattcaattagtaggatgctgtctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattg

SEQ ID NO: 45 - DNA, 222 bp; single-stranded, linear
  immediate source library: LIVRNOT01
  immediate source clone: 085523
attactttggcctccanttcctcgactctgcccaggttgcgcactggctggttcatgccaaacccataaaaaagcagatgaaaatnggacctgcttatgctttacactttcnanttaaatactattcttcagaaccaaacaaccttngtnaggngtttacaaggtacctntttgttttacaactcaggcatgacattnttnntggaaaatngaaatgccctt

SEQ ID NO: 46 - DNA, 1842 bp; single-stranded, linear
  immediate source library: LIVRNOT01
  immediate source clone: 086700
gttctgctccttttacttcaggcgaacctgaactcagttaatgcaattttgaagcatgccctgaatagattcagtcattaccaagtcaaactaaaaacggtgaaaggttgcgactattaccaaataggaaaaatctgaagacataagaactacacatgaggaatatgtcatttagcactttcactttttgatctccacagaaggcaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttattttcatcgtgggactggttgggaacataatcgccccctatgtatttctgggtattcaccgtaaaagaaattccattcaaatttatctacttaacgtagccattgcagacctcctactcatcttctgcctccctttccgaataatgtatcatattaaccaaaacaagtggacactaggtgtgattctgtgcaaggttgtgggaacactgctttatatgaacatgtacattagcattattttgcttggattcatcagtttggatcgctatataaaaattaatcggtctatacagcaacggaaggcaataacaaccaaacaaagtatttatgtctgttgtatagtatggatgcttgctcttggtggattcctaactatgattattttaacacttaagaaaggagggcataattccacaatgtgtttccattacagagataagcataacgcaaaaggagaagccatttttaacttcattcttgtggtaatgttctggctaattttcttactaataatcctttcatatattaagattgggaagaatctattgaggatttctaaaaggaggtcaaaatttcctaattctggtaaatatgccactacagctcgtaactcctttattgtacttatcatttttactatatgtgtgggtccctatcatgcctttcgattcatctacatttcttcacagctaaatgtatcatcttgctactggaaagaaattgttcacaaaaccaatgagatcatgctggttctctcatctttcaatagttggttagatccagtcatgtatttcctgatgtccagtaacattcgcaaaataatgtgccaacttctttttagacgatttcaaggtgaaccaagtaggagtgaaagcacttcagaatttaaaccaggatactccctgcatgatacatctgtggcagggaaaatacagtctagttctgaaagtacttgaggtaaacatactgaaatgaattatataatgcagcctcttaattctttgaagaactaaaaaattaggaaacaaagttcctagcatttacaaaactcagatgctcaaagctctgcttgtatttgtgatatttcatttgcttaactgtaaaccatttcaaggtactatcttttaaatctgtatgtaaaatcttttcaaaatacatttttaagctaatactcttaacatagattatgaagttaagtgaaatttatggctctaacagccaaataattaaagtgccatagtttctcaagtgactaaagtagttattaaaatcaagcacttgatactaatttgaagtgtgttttaaaagtaaatgatttgggaactgacaatgtgtcagaaaatatatgttcatttatcattttaaaatcttgtataatttgccactgtattcatttatgcctaaatctctataacagatgaaaagataattaataaaatcctaatt

SEQ ID NO: 47 - DNA, 570 bp; single-stranded, linear
  immediate source library: LIVRNOT01
  immediate source clone: 087825
cggaccaccagcaacagacaacatcttcattcggctctccctgaagctgtactgcctcgctgagaggatgaaggtctccgaggctgccctgtctctccttgtcctcatccttatcattacttcggcttctcgcagccagccaaaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcg

SEQ ID NO: 48 - DNA, 301 bp; single-stranded, linear
  immediate source library: LIVRNOT01
  immediate source clone: 088200
cctactcggggcttattggcacagtcatgacccccaactacatagactccagtagcctcagtgtggccccatggtgtgactgcagcaacagtgggaacgacctagaagagtgcttgaaatttttgattttnttcaaggacaatacatgtnttaaaaatncaattnaagcctntggcaatggctccgntgtgaccgtgtggcagccagnntatctagnanagacagnactgtnnctaanaacaattcnctacgggataagcacaggatcctnggttcaatagggtcttggaatngantccna

SEQ ID NO: 49 - DNA, 795 bp; single-stranded, linear
  immediate source library: LIVRNOT01
  immediate source clone: 088564
tgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagccacaagctattttttaaaaaaaaactatttaacattcttttgtttatattgttttgtcccctaaattgttgtaattgcattataaaataaggaaaatattaataagacaaatattgaaaataaagaaacaaaaagtt

SEQ ID NO: 50 - DNA, 212 bp; single-stranded, linear
  immediate source library: HYPONOB01
  immediate source clone: 090012
acactgaggacaatgcggctatagcagatggccatggcagtcagtggcagcagaaagaggcagcagaaggtgaagaggttataggtggtctcttgccattnagccttgaagctgcctttggtgacacactgagtgaaagggactgggccagctcagtggaccgtgtggaacaggaacagctggagtggagttgaggactattagaactggtt

SEQ ID NO: 51 - DNA, 203 bp; single-stranded, linear
  immediate source library: HYPONOB01
  immediate source clone: 090447
gcggncatnacagattccntatncaatcgtnctttgattgttancaccattttngnagngccttatgtccnntttaagaagtntgacaaacctctctatggtaatgatcgctttgaaggctattgcattgatctcctcagagagttatctacaatccttggctttacatatgaaattagacttgtggaagatgggaaatatgg

SEQ ID NO: 52 - DNA, 181 bp; single-stranded, linear
  immediate source library: HYPONOB01
  immediate source clone: 090818
gtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggngccattatagtttnaagctgtcactgctgcatgtt

SEQ ID NO: 53 - DNA, 206 bp; single-stranded, linear
  immediate source library: HYPONOB01
  immediate source clone: 090851
gagaaacaagcggggccgggagtatgtggacgagtctgcctgtccttatgttatggccaatgttgcaacaaaaatttttcaagaattggtagaaggtgtgttttacatacataacatgggaattntgcaccgagatctnnagccaagaaatatttttnttcatggccctnatcagcaagtaaaaataggagactttngtctggcct

SEQ ID NO: 54 - DNA, 240 bp; single-stranded, linear
  immediate source library: HYPONOB01
  immediate source clone: 091945
gaccaaaggcaagaagaagtccaagaagcagcctccaggcagcgaggaggcagcgggggagccggtgcagaatngcgcgccagaggaggagcagctcccgcctgantccagctactccctnctcgctgaaaattcctattttaaaatnacctttgacatccggggcagtntncaggaggacagccaggtcactntngccatcgtnctngagaacaggngcagcagcatccttcangnttt

SEQ ID NO: 55 - DNA, 209 bp; single-stranded, linear
  immediate source library: HYPONOB01
  immediate source clone: 092298
atcatataggctgcaaggactgaanccaaacagcttatactatttccntntggctgcacgctcccctcaaggcctggntgcttctactgcagaaatatcagctagaaccatgcagtcaatgtttgcaaaaanttttnatgtcaaagcagtaatgangacttccgtnttgctgtcttgggagattccagagaattataactccgccatgc

SEQ ID NO: 56 - DNA, 226 bp; single-stranded, linear
  immediate source library: HYPONOB01
  immediate source clone: 093414
agattttaatccttacattacctgctatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattagaaatnttgaggttggacaatacattagaggaaattatatttaagctggtccctggg

SEQ ID NO: 57 - DNA, 290 bp; single-stranded, linear
  immediate source library: HYPONOB01
  immediate source clone: 093797
tggaaaaggacatccgatactctttcatattagacatacagtatgctcctgaagtttcggtaacaggatatgatggaaattggtttntaggaagaaaaggtgttaatctcaaatgtaatgctgatgcaaatccaccacccttcaaatctgtgtggagcaggttggatggacaatggcctgatggtttattggcttcagacaatactcttcattttgtccatccatttgactttcaaattattctgggtgtttatatcctgtaaagtggcccaattncctttggtcaaaag

SEQ ID NO: 58 - DNA, 887 bp; single-stranded, linear
  immediate source library: HYPONOB01
  immediate source clone: 093801
ctaanantggctcggagcngggcccnctnaggnntccctggcctttgtccttccacctgtccacaagcatggggaacatccncgccaacctcttcaagggcctttttggcaaaaaagaaatgcgcatcctcatgntgggcctggatgctgcagggaagatttttatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccntaacacacaaggcctgatcttcgtggtggacagcaatgacagagagcgtgtgaacgangcccgttgaggagctcatgaggatgctggccgaggacgaactccgggatgctgtcctcctggtgttcgccaacaagcaggaactccccaacgccatgaatgcggccgaaatcacagacaagctgggggttgcactcactacgccacangaactggtacattcangccacctgcaccaccatcgggtacgggcaatcaccgaccattgccccgaaggcgaaagttaccgaaagcacagtnatcactggtgtcgaaattgtcatgaaccatcacctgcnggaaacaatttcccnaaaaaaaccttacnaaaattctccaaaatacttgaaatccatccaagggaacttgaagaaacgaaaccnaaaaatttaacttttntgaaagggggtgcanaanaatcaacctcccttgctatttcaaaataccattctttttggtgaaactgaatcccanngcttgttgtctnttgaataccgtgaagaagggtanccccttttgatttctttangaagnn

SEQ ID NO: 59 - DNA, 246 bp; single-stranded, linear
  immediate source library: PITUNOT01
  immediate source clone: 095210
atccttcagaaaaagcatccccgaggaggaagacgaatcgttaaacatcttaggtcagctctagcctctcggaattttttttcttcagtggaaaccccgagaagactgatcagttcttcagttctaaaacaatggcccagggtttngtgacgttcgccgacgtagccatagacttttttnaggaggagtgggcctntttgaactctgctcaaaggganctttactnggacgtgatgcttgagaant

SEQ ID NO: 60 - DNA, 555 bp; single-stranded, linear
  immediate source library: PITUNOR01
  immediate source clone: 097307
nnaggaaaagggggaggccnccggggacnaaacgccgtttgacttgtaggtgagagaacgccgagccgtcgccgccncctccgccgccgagaagcccttgttcccgctgctgggaaggagagtctgtgccgacaagatggcggacggggagcttntcntggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctggaaatttgttggagatattccatggacaatatacagatttactggagattatttgaaatatggaggttttccccacccagaaacccaactatcttttcctttaggaaaattatgtttggaccagaaggaaaagccatcctttttggaaaaccatttgttttgctaatttggcgtttataaaatcccaatatccccgaaaaantcnttctcccctaagaagaaaaaccgaattttttgctngcnnc

SEQ ID NO: 61 - DNA, 243 bp; single-stranded, linear
  immediate source library: BRSTNOT03
  immediate source clone: 1001651
cactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctncagaagcacctggatacccacagcgaggagccagctacaggt

SEQ ID NO: 62 - DNA, 229 bp; single-stranded, linear
  immediate source library: ADRENOT01
  immediate source clone: 100279
gnagaaggccacagttgacaacaaagacaaactggaggaaaccnctggnctnaaaatcctncaaaccggagtcgngtcggagctgtgccgccagcgtatggcanggggcanttttcctacctgagggcccgcacacgtcacgnatcagcagcgtctcatcccagttcagcgacgggccgatccccagcccctncgnacgnagcagcgcctcatnctnggtccgaggagc

SEQ ID NO: 63 - DNA, 1146 bp; single-stranded, linear
  immediate source library: BRSTNOT03
  immediate source clone: 1003663
tggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgcttcttgctaccaggacsagaaaaskaywcakyctmktkcctcccrcysmsmtgcacymwrcrgccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtgggaatagtgagggaaatcccagcaagcaggatctggatcccgtctgtatttattgggggaggaggaagcttccgaggtaccctgcggtgccctctttkttgttg

SEQ ID NO: 64 - DNA, 797 bp; single-stranded, linear
  immediate source library: BRSTNOT03
  immediate source clone: 1004370
ctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgstacggaaagaagtatgggccaaaaggctacggttatggccagggcgctggcacgcttaamatggaccgtggcgagaggcttggcatcaaaccagagagtgttcagcctcacaggcctacaacaaatccaaacahttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctcccttt

SEQ ID NO: 65 - DNA, 340 bp; single-stranded, linear
  immediate source library: ADRENOT01
  immediate source clone: 101415
tggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacancggcttaacactatnatggactacaccagggtcctggtcctggacaaaggngtagtagctgaatttgnttntccagccaacctcattgc

SEQ ID NO: 66 - DNA, 199 bp; single-stranded, linear
  immediate source library: BMARNOT02
  immediate source clone: 104119
gatgagtatgatgtatgtcccatttntttggctgagtatgangatggagacaaactcagagtccttccctgttcccatgcttatcattgcaagtgtgtagncccntggctaactnnanccaanaaaacctgnccagtgtgcaagcaaaaagttgttccttctcanggcgattcagactctgacacagacagtagtcant

SEQ ID NO: 67 - DNA, 222 bp; single-stranded, linear
  immediate source library: BMARNOT02
  immediate source clone: 104941
caggcaatgcgtggtttcataaccacatcatagtgtaaggggttgcagatggccaccagccggtcgatggccatagaggccagcaggtagctgtcagtgttcccaaatgccataaagaagtacatctgggccaggcagcccacataggagataacctttgtctctgatagaaaattcaccagcatcttaggcactatgactnttgtgaagcagatatccatt

SEQ ID NO: 68 - DNA, 207 bp; single-stranded, linear
  immediate source library: BMARNOT02
  immediate source clone: 105400
ggaccagggaaaaggagaggtcaacaatcaagatatccggagttcaggttaatgtgaaatccattatccaacatgaagaggagtttnanatgctgcataaatctatccctgtggaccctgaagaaaaaaaaaaatactgcttaacctgtcgtgtcaaagctgcacattttnatgtagagtggggggtggangatgattctcgcctct

SEQ ID NO: 69 - DNA, 202 bp; single-stranded, linear
  immediate source library: AMLBNOT01
  immediate source clone: 108614
tgcagaagggagggggaaacatacatttattcatgccagtctgttgcatgcaggctttttggcttcctaccttgcaacanaataattgcaccaactccttantgccgattccgcccacagagagtcctggagccacagtcttttttgctttgcattgtaggagagggactaagtnctagagactatgtcgctttcctgagct

SEQ ID NO: 70 - DNA, 212 bp; single-stranded, linear
  immediate source library: PITUNOT01
  immediate source clone: 111294
gntcatcgcttactaaacatgagaaaacacataaaggagagggagctttccctaatggaacagatcaaggaatttntcctggaaagaaacaccatgaatgtaccgactgtgggaaaacctttntntggaagacacagcttactgagcatcagagaattcacactggggagaaaccctttgantgcaatgtatgtggaaaggccttcaggcat

SEQ ID NO: 71 - DNA, 168 bp; single-stranded, linear
  immediate source library: PITUNOT01
  immediate source clone: 111639
ccacncccgacgctcactcacaggcccccggagttacccgtgtgaggagtgcgggtgcagcttcagctgnaagtcgcagctggtcatccaccgcaagagccacacaggccagcggcgtcacttctgcagtgactgtggccncgccttcnactngaagtncagctngtc

SEQ ID NO: 72 - DNA, 260 bp; single-stranded, linear
  immediate source library: PITUNOT01
  immediate source clone: 112132
gaaaactcacactggtgaaaaaccctttggatgtaaggaatgtgggaaggccttcagccgtgcctcacaccttgttcagcatnagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactc

SEQ ID NO: 73 - DNA, 393 bp; single-stranded, linear
  immediate source library: PITUNOT01
  immediate source clone: 112530
aaagttcggagccctgccccngccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagaggagctacatttgaagcct

SEQ ID NO: 74 - DNA, 527 bp; single-stranded, linear
  immediate source library: PITUNOT01
  immediate source clone: 112808
ccttcaggtaccagccatccagacagtgcttgagctgcagaaactgagaccagacctctggcctggccctccccaggggcctcctttcctatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctyctctgagctcccctgtcccttctcacaactsctcccttttccctctcctgggcccttccttaggtcagtaattgttgtgag

SEQ ID NO: 75 - DNA, 144 bp; single-stranded, linear
  immediate source library: PITUNOT01
  immediate source clone: 112909
gtgactgtgccggcaaaantttcactcaacagtaccggctcacagaacacattcgagtccacagcggggagaagcccttccagtgtccggagtgtgacaagagctactgcatcaggggcagcttgaaggtccacttgtataagc

SEQ ID NO: 76 - DNA, 719 bp; single-stranded, linear
  immediate source library: TESTNOT01
  immediate source clone: 113700
cgggcgtcaagtgggtccccggtcggaaaaaagcgcggtttggatgacaaacattggggtgagctacacccccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaatgaaaaacctctccaagtcctggtggaagaagtactgctgtttcgtatgatgctggcaagacacccagaaaggctattttcagatgaatcgatattagagcttattagtgaaacaactcttttactggtggac

SEQ ID NO: 77 - DNA, 291 bp; single-stranded, linear
  immediate source library: TESTNOT01
  immediate source clone: 114290
cnggcacgagaaaagcttcagccggagctcatttcttattgaacatcagagaatccacactggtgagagaccctatctntgcagacagtgtggaaaaagctttagtcagctttgtaatcttattcgacatcagggtgttcacacaggtaataaaccccataaatgtgatgaatgtggnaaggcctttagccggactcgggtcttattcagcatcngagggtacacacagggggtgaacccttntaaagtntgngaaagtgcgncnaaaaggtttcagtcaaccagcgnttc

SEQ ID NO: 78 - DNA, 269 bp; single-stranded, linear
  immediate source library: TESTNOT01
  immediate source clone: 114973
gacggtggccatttgacatgtggagcctgggntgcatcacggtggagttgtacacgggctaccccctgttccccgggnagaatgaggtggagcagctggcctgcatcatggaggtgctgggtctgccgccagccggcttcattcagacagcctccaggagacagacattctttgattccaaaggttttcctaaaaatataaccancaaccaggggnaaaaaaagattnccagattccaagggccctcacggattggtgctgaaaaaact

SEQ ID NO: 79 - DNA, 793 bp; single-stranded, linear
  immediate source library: MUSCNOT01
  immediate source clone: 119819
gggccccgngcccnngatgatagctttacntttggtggtggggacagcggcggcagcggnggccntanccccagctcacaagcctcctgcgggcccgagtcctcgggctccgaactagccctggccacaccggtgcctcagatgctnnttntttnttctgggctccgacgacgaggaacaggaagaccccaaagactactgcaagggcggctaccaccctgtgaagatcggcgacgtgttcaatgggcggtaccacgtggtgcncccnccnngctggggccacttctccaccgtctggctctgctggganttccnncgcaagcgctttgtggccctcaaagtggtgaanagtgcggggcattacacgggagacagctgtggatgaaatcaanctcctgaaaatgtgtccgggacagcgaccccagtgaccccaaaagaaagaccattgtccanctcattgatgacttcaggatctcangagtcaatggantccatgtgtgcatggtgctggangtgctgggccaccanctcctcaaatggatcntcaantccaactaccanggcctgcccgtgccctgccttnaanaacatcntnangcangtgctgcacngctgnantaccccacaccnanttgcaanatcntccacncggaaatcaanccccaaaacatcttgctgtgtgtgggggaccttacatcnngcncctngctgccnaggccnngaatngcacangnnggggggccnccccctcccctncatattnnnatgcccccnnnaagtttgaacggtaact

SEQ ID NO: 80 - DNA, 222 bp; single-stranded, linear
  immediate source library: MUSCNOT01
  immediate source clone: 120376
gattacaagtagcttggnttgtagtggaaaaaaacgagagattaaccattccaagcagttgccccagaagttttgctgaactnttacatcagtnttgggaagctgatgccaagaaacggccatcattcaagcaaatcatttcaatcctggngtccatgtcaaatgacacgagccttcctgncaagtgtaactcattcctacacaacaaggcggagtggaggt

SEQ ID NO: 81 - DNA, 247 bp; single-stranded, linear
  immediate source library: BRSTNOT02
  immediate source clone: 1210401
gagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagagctgctggctgcaggtgcggaggtgaacancaagggcctagatgacgacangnctttnnacgacgttgccaanaggggcantanaaggtgtgaagt

SEQ ID NO: 82 - DNA, 254 bp; single-stranded, linear
  immediate source library: BRSTNOT02
  immediate source clone: 1210506
catggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaaggtgagccctggcttcgtacacaccatcctgtttaccttggctgtgcctcctgggaaactcaacacactttcagatt

SEQ ID NO: 83 - DNA, 241 bp; single-stranded, linear
  immediate source library: BRSTTUT01
  immediate source clone: 1215274
tgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgt

SEQ ID NO: 84 - DNA, 1239 bp; single-stranded, linear
  immediate source library: MUSCNOT01
  immediate source clone: 121894
gatgataaatgcatgtcattatttatttagatgtttcagctctcgcactaagtttttacaagctggtgaacactgacaaaattatttctcccacagaactataaccacacatccccagacagtataaatatatggttgaactaacattaatacacatcaccattttatcaattacataataaaacaaattgtcaagtatccaaatattaagttacacagctcaaaaggcatataaaatattagatgtctgctcaattcattagcagaaacccatttctttttttgcaagagaggttgggaaggaaaaaaaaaatcacactttcaaacaaaaataagttggtaaacacacttctgataagtatgggaaaaaaattacaggatttcaggaagtttatggttacaataacaaggcatctctaccttttaaaaaatattttactaattaaagggcatttctacatgtttkctrcwgtgcaagggcaccwtttgctaagatttattgattgttttttttttcactttccccatcacactcacangnacgntcacactttttatttgccataatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagangtatcgtcctaaaatgcggctgcgtttcaaagattccaacggtcatagaaacaactgttgcattcaataaaattggggtgcctaatgctactggaagtggracttgagatagggcctaattttgttataccatattagccaacatgttggcttagtaagtctaatgaagcttccataggggtattnaaaggcagttttnccaggcctcaagctagacagattttncaatg

SEQ ID NO: 85 - DNA, 249 bp; single-stranded, linear
  immediate source library: NEUTGMT01
  immediate source clone: 1221143
ctcctagaggccaagggccccgtgaccgacgtggcctactnccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagt

SEQ ID NO: 86 - DNA, 221 bp; single-stranded, linear
  immediate source library: COLNTUT02
  immediate source clone: 1223546
ggcgcccccagcggactnccgggaccgacggaggtcctaccagatgcctgtgcgggatgaggagtcggaatcccagagaaaagctcgctcccgtctnatgcgccagtntnggaggtccacacagggtgtgactcttacagacctgaaggaggcagagaaggctgcagggaaggccccagagtcagagaagccggcgcagagcctggtgagaggggtcagcg

SEQ ID NO: 87 - DNA, 247 bp; single-stranded, linear
  immediate source library: COLNTUT02
  immediate source clone: 1223714
gaatttcggaaccctagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgncacgtccaccacca

SEQ ID NO: 88 - DNA, 279 bp; single-stranded, linear
  immediate source library: BRAITUT01
  immediate source clone: 1229372
ctctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttctaccaaggagctggcacgg

SEQ ID NO: 89 - DNA, 244 bp; single-stranded, linear
  immediate source library: BRAITUT01
  immediate source clone: 1231274
atcaagtcccgngccccgcagctgcacctggagtaccggttctacaagcagctcagcgccacagagggcgtccctcaggtctactacttcggtccgtgcgggaagtacaacgncatggtgctggagctgctggggcccagcctggaggacctgttcgacctgtgcgaccggaccttnanggtnaagacggtgctgatgatcggcatccagctgatcangngcatggagtatgtgcacancaaga

SEQ ID NO: 90 - DNA, 234 bp; single-stranded, linear
  immediate source library: BRAITUT01
  immediate source clone: 1231667
catacctgctgggagcatcatctttaaggtccatgcggtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggt

SEQ ID NO: 91 - DNA, 279 bp; single-stranded, linear
  immediate source library: LUNGFET03
  immediate source clone: 1234795
gggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaaccataaggttgaccattgattgccagtcagaag

SEQ ID NO: 92 - DNA, 239 bp; single-stranded, linear
  immediate source library: LUNGTUT02
  immediate source clone: 1238083
aggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatg

SEQ ID NO: 93 - DNA, 264 bp; single-stranded, linear
  immediate source library: LUNGTUT02
  immediate source clone: 1238311
cgctctgtgaagaagctggtcaacgtgattatcctcaccttcttttgcctcagcatctttgccctggtaggtcagcagctcttcatgggaagtctgaacctgaaatgcatctcgagggactgtaaaaatatcagtaacccggaagcttatgaccattgctttgaaaagaaagaaaattcacctgaattcaaaatgtgtggcatctggatgggtaacagtgcctgttccatacaatatgaatgtaagcacaccaaaattaatcct

SEQ ID NO: 94 - DNA, 224 bp; single-stranded, linear
  immediate source library: LUNGNOT03
  immediate source clone: 1242602
cagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtg

SEQ ID NO: 95 - DNA, 818 bp; single-stranded, linear
  immediate source library: LUNGNOT03
  immediate source clone: 1243031
cccttnttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcagtttgcttttcgactatatgatttggataaagataacaagatctctcgtgatgagctgttaagggtgctgtgcatgatggtccaaataaatatctcagataagcagctgggcagtatcgcagacaggaccattcaggaggctgatcagcatggggacagtgccatatctttatcacagactttgctaaggttttggagaaggtggatgtagaacagaaaatgagcatctgattttttcactaaaggncagacagcaaactattccttgcagtctagtatttaagtactggaacttgacagtcctcctntccaccagccctacctccaccccatnattccccttntnccaaaagtactactgctgnttgcataaca

SEQ ID NO: 96 - DNA, 240 bp; single-stranded, linear
  immediate source library: LUNGNOT03
  immediate source clone: 1243069
ggactgacaactggcagtaaagnacaaaggatgtcaggnctgcggaccggcactcaagtggaccctgagattgagctttttgtaaaggctggaagtgatggagagagtattggaaactgtcccttttgccaacgncttttcatgatcctctggcttaaaggagttaaatttaatgtgacaactgttgacatgaccagaaagcctgaagaactaaaggacttagccccaggtaccaatcct

SEQ ID NO: 97 - DNA, 192 bp; single-stranded, linear
  immediate source library: LUNGNOT03
  immediate source clone: 1243412
gctggagctgtgaagttaaaccgacaacagactgatatggctgttaattgggctggaggattacatcatgctaagaaatcagaagcatcaggattctgtacgtaatgatatgtgttccatcctgattctaagttctcgggtattatgttgttctntggtggtggagttttcacgtggtatacgntatctata

SEQ ID NO: 98 - DNA, 177 bp; single-stranded, linear
  immediate source library: LUNGFET03
  immediate source clone: 1251148
caagaatggtgtactcaaagtcctaaaagctttggatcgggaaagtcagtccttctacaacttggttgttcaagtgcatgacctgccacagattccagcctccagattcacaagcactgtcaagtctccattattttgttggatgtaaatgataacccaccgacatttctttcccct

SEQ ID NO: 99 - DNA, 228 bp; single-stranded, linear
  immediate source library: LUNGFET03
  immediate source clone: 1251228
gcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacga

SEQ ID NO: 100 - DNA, 207 bp; single-stranded, linear
  immediate source library: LUNGFET03
  immediate source clone: 1252862
ctgccatcgtctcccccatcgtcaagcaggaaccggcaccccccagcctgagccctgcagtgagcgtgaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattg

SEQ ID NO: 101 - DNA, 297 bp; single-stranded, linear
  immediate source library: MENITUT03
  immediate source clone: 1255202
gcggcggagacagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagcca

SEQ ID NO: 102 - DNA, 346 bp; single-stranded, linear
  immediate source library: MENITUT03
  immediate source clone: 1255239
ccatgtggaaaagtctttaccttaactccaggccttgctgtgcatcttgaaattctcaatggaagacaaccctacaaatgtaaggaatgtggaaaaggctttaagtattttgcaagccttgataatcacatgggaatccacattggagagaaactctgtgaatttcaggaatgtgagagagccatcacaacttcctcacacttaaagcagtgtgtaacagttcatactggaaagaaatctaaaaagactaagaaacatgggaaatccttcactaatttttctcaactttctgcacatgtgaaaattcataaaggagagaagtcctttgaatgtaaagaatgtggga

SEQ ID NO: 103 - DNA, 246 bp; single-stranded, linear
  immediate source library: MENITUT03
  immediate source clone: 1256053
gccgggatcatggtctgcggcacccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccact

SEQ ID NO: 104 - DNA, 219 bp; single-stranded, linear
  immediate source library: MENITUT03
  immediate source clone: 1257462
ctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggac

SEQ ID NO: 105 - DNA, 228 bp; single-stranded, linear
  immediate source library: MENITUT03
  immediate source clone: 1258320
ccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtg

SEQ ID NO: 106 - DNA, 239 bp; single-stranded, linear
  immediate source library: SYNORAT05
  immediate source clone: 1261646
ggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttnttncggtgctgctgacgctagtcttctggaagttaatccggagcagaaggagcagtcagagagctgttcttcttgttggnctttgtga

SEQ ID NO: 107 - DNA, 273 bp; single-stranded, linear
  immediate source library: BRAINOT09
  immediate source clone: 1266440
ccatcgacgaggacgtggccgaagcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttc

SEQ ID NO: 108 - DNA, 246 bp; single-stranded, linear
  immediate source library: BRAINOT09
  immediate source clone: 1268848
cattttggaacagcagaaaggaaacagagtgcctctctgcatcaaccctcagtctgctgcttttaagagctttattagttccactgttgctcagccatctgagatgcccccatctcctctggtgtgggagtgatggtggaagataatgtactactgaagatgtaatgtagctttccactggagtctgggatttgcaattctggaggttaatcatgcttgtactgtaattttactaatgaagtttta

SEQ ID NO: 109 - DNA, 218 bp; single-stranded, linear
  immediate source library: BRAINOT09
  immediate source clone: 1269556
catctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatag

SEQ ID NO: 110 - DNA, 243 bp; single-stranded, linear
  immediate source library: BRAINOT09
  immediate source clone: 1270334
tccagcgatagtctcccgggctcgcctacgcacgggctgccggcgcgctcgcccacgcacagctaccgctccacgcctgactccgcctacctaggcgcctcatcccagagcagctccccagcctcgagcacgcccaactcgcctgcgtcgtcggcgtcgcaccacattcggcccagcacgctgcacggactgtcgccaaagctccatcgccagtaccgtctgcgcgatgcaagtcggccggca

SEQ ID NO: 111 - DNA, 260 bp; single-stranded, linear
  immediate source library: BRAINOT09
  immediate source clone: 1270442
agagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgcnatgtgganaaaaatcttcaagaattgcaacgangaggcggccaatttcgtcaatctgctnatgaagcccnggntgaaatnacntgntgnaggaggantttnt

SEQ ID NO: 112 - DNA, 820 bp; single-stranded, linear
  immediate source library: TESTTUT02
  immediate source clone: 1272054
ctgcctgcggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtgcgttcttcacaaaggaggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacancccctgcctgggccatggccagctctaggtggattctgattcactgtcaatgctgggttgctcccgagccctagatgttcct

SEQ ID NO: 113 - DNA, 301 bp; single-stranded, linear
  immediate source library: TESTTUT02
  immediate source clone: 1274145
ggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtattcgctttctcccagacca

SEQ ID NO: 114 - DNA, 248 bp; single-stranded, linear
  immediate source library: COLNNOT16
  immediate source clone: 1281655
cgcgctcngcgctggcctgctgccccggcgggtccgccggccggaggggggagtcacaggaagagccctccacaaaangaggcctcggcggatcaggncagctgcaggtgggtgtncagactggtgagctgccagcaggggcccagacgcgccaggcctggagatggctggaaactgctcctgggaggcccatcccggcaacaggaacaagatgtgccctggcctgancgaggccccggaantctaca

SEQ ID NO: 115 - DNA, 243 bp; single-stranded, linear
  immediate source library: COLNNOT16
  immediate source clone: 1282128
gcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatat

SEQ ID NO: 116 - DNA, 256 bp; single-stranded, linear
  immediate source library: COLNNOT16
  immediate source clone: 1283291
atgagctccacctctaccctgggcttccggatcgagggcatcaagaaggcagatgggacctgtaacaccaacttcaagaagacgcaggcactggagcaggtgacaaaagtgctggaggacttcgtggatggagaccacgtcatcctgcaaaagtacgtggcatgcctagaagaacttcgtgaagctctggagatctcccccttcttcaagacccacgaggtggtaggcagctccctcctcttcgtgcacgaccaca

SEQ ID NO: 117 - DNA, 240 bp; single-stranded, linear
  immediate source library: BRAINOT11
  immediate source clone: 1287810
ttggatttaattaaaatttatttttaactggaaattaacttttaaaaaggctgcaagggcctttagaaattgattatattttgttattaattttgggaagacttaacagcaaatgtctaacattatagaataagtgaaattggagaatatgtaataagttttgtttgcaggtaacaggactggatttttttttctttgcactactttatatgctggagattgagagagacttcaaactgt

SEQ ID NO: 118 - DNA, 669 bp; single-stranded, linear
  immediate source library: BRAINOT11
  immediate source clone: 1290913
gcgacgggccgcnggggcggcgccgccatngcgccgtgtttgatttggattnngagacggaggaaggcagcgagggcgagggcgagccagagctcaacnccgcggacgcatgtncccttgccgagttgagggcagctggcctagagcctgtgggacactatgaagagggactgagaccagcgtgaacgttggcccagagcgcatcgggccccactgctttgagctgctgcgtgtgctgggcaaggggggctatggcaaggtgttccaggngcgaaangtgcaaggcaccaacttgggcaaaatatatgccatgaaagtcctaaggaaggccaaaattgtgcgcaatnccaaggacacagcacacacacgggctgagcggaacattctagagtcagtgaagcacccctttattgtggaacnggcctatgccttccagactggtggcaaactctaccccatccttgagtncctcagtggtggcgagctcttcacgcatctggagcgagagggcatcttcctggaagatacggcctgttctaccnggctgagatcacgctggccctgggccatctcactcccagggcatcatctaccgggacctcaagcccgagaacatcatgctcagcagccagggccacatcaaactgancgantttggactctgcaagg

SEQ ID NO: 119 - DNA, 229 bp; single-stranded, linear
  immediate source library: BRAINOT11
  immediate source clone: 1291082
ttttttttggaagatactgttttgtttttaattatacaaaattttcagactttatattatcatatcaaaaacacaagatgccatcacacagtggccggaaganaagccagcgcagaaagttccagtgggcccgggcaggtgctggggccagcgcagagtcccgctgccggcgcctgtctgtacgtccgtctgtccctcggccccgctcgcagccagggctggcctgggg

SEQ ID NO: 120 - DNA, 703 bp; single-stranded, linear
  immediate source library: PGANNOT03
  immediate source clone: 1292876
gactnaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaattnaattnttccttttgggggtaaagtttgctctaccaaatagtgattgta

SEQ ID NO: 121 - DNA, 246 bp; single-stranded, linear
  immediate source library: BRSTNOT07
  immediate source clone: 1296847
cacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggaccc

SEQ ID NO: 122 - DNA, 262 bp; single-stranded, linear
  immediate source library: BRSTNOT07
  immediate source clone: 1298633
gcaagancgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgcnggcgcntcaagaaggagaacaagatgacntgggccccgagaaacaaaagcgaagatgaggacgaggacgagggcgangttaccagaggnanggnngngantccnga

SEQ ID NO: 123 - DNA, 263 bp; single-stranded, linear
  immediate source library: BRSTNOT07
  immediate source clone: 1301193
gaattccacaggtcgcccccccttccacgagctcgggagcccacaggctgccatgtttcaggtgggtatgtacaaggtccatccgccaatgcccagctctatgtcggccgaggcccaagcctttctcctccgaacttttgagccagacccccgcctccgagccagcgcccagacactgctgggggaccccttcctgcagcctgggaaaaggagccgcagccccagtccccacgacatgctccacggccctcagatgccccttc

SEQ ID NO: 124 - DNA, 237 bp; single-stranded, linear
  immediate source library: PLACNOT02
  immediate source clone: 1303605
ccttgaacagcattgttgcaaaacataaggagttggaggggaccagccaggcttcagctgaataccaagttttgcagattgtgtcggcaatggaaaactatggcatagaatggcattctgtgcgggatagcgaagggcagaaactgctcattggggttggacctgaaggaatctcaatttgtaaagatgactttagcccaattaataggatagcttatcctgtggtgcagatggcca

SEQ ID NO: 125 - DNA, 248 bp; single-stranded, linear
  immediate source library: PLACNOT02
  immediate source clone: 1305513
ggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctg

SEQ ID NO: 126 - DNA, 1607 bp; single-stranded, linear
  immediate source library: COLNFET02
  immediate source clone: 1309709
gtatcnctgccanggnggcccccacccnaaancaggggggtnggggccggccggccagggccatgtcctgagnccccnnggcgtgcctcctggaacagatatgcccgccagccagcccattgacntcccgggcgccaagaanaggggcaagaanaataagcgcggccgggccaccgacagcttctcgggcaggtttgaanacgtctaccanctgcaggaanatntgctgggggagggcgctcatgcccgagtgcagacctgcattaacctgatcaccagccaggagtacnccgtcaanatcattgntttttttncaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctggtggcagcgactgcggctgggaccgctgatgtacgacatgctcactggatcgccgccctttaccgcagagaaccggaagaaaaccatggataagatcatcaggggcaagctggcactncccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgtaggaagccgggtgggggtgagggtagcccttgagccctgtccctgcggctgt

SEQ ID NO: 127 - DNA, 1033 bp; single-stranded, linear
  immediate source library: COLNFET02
  immediate source clone: 1311434
agaagacagcgaaatggcgcctccggcccccggcccggcctccggcggctccngggaggtagacgagctgttcgacgtaaagaacgccttctacatcggcagctaccagnagtgcataaacgaggcgcaacgggtgaagctatcaagcccagagagagacgtngagagggacgtcttcctgtatagagcgtacctggcgcagaggaagttcggtgtggtcctggatgagatcaagccctcctcggcccctgagctccaggccgtgcgcatgtttgctgactacctcgaccacgagagtcggagggacagcatcgtggccgagctggaccgagagatgagcaggagcgtggacgtgaccaacaccaccttcctgctyatggccggcttcatytatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacggtcccagcgcctgaggctggcccagagctgtcaggaccatgaagccaggacagaggccaggagccagccctgcagcccttcccacccggcatccacctgcattccct

SEQ ID NO: 128 - DNA, 232 bp; single-stranded, linear
  immediate source library: BLADTUT02
  immediate source clone: 1312824
agtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagc

SEQ ID NO: 129 - DNA, 1336 bp; single-stranded, linear
  immediate source library: BLADTUT02
  immediate source clone: 1313615
gaggggtccagcctccacagcgagcctgagagggccggcctcgggcctgcgccggggacagagagtccgcagcagaattctggacagacggacagactgagcccgcggcagctggccttggagtagagaccgagaggcccaagcaaaagacggagccagacaggtccagcctccggacgcatctagaatggagctggtcagagctggagacgacttgtctttggacggagaccgggacagatggcctttggactgatccgcacaggtccgacctccagtttcagcccgaggaggccagcccctggacacagccaggggttcatgggccctggacagagctggaaacgcatgggtcacagactcagccagagagggtcaagtcctgggctgataacctctggacccaccagaacagttccagcctccagactcacccagaaggagcctgtccctcaaaagagccaagtgctgatggctcctggaaagaattgtatactgatggctccaggacacaacaggatattgaaggtcccttgngacagagccatatactgatggctcccagaaaaaacaggatactgaagcagccaggaaacagcctggcactggtggtttccaaatacaacaggatactgatggctcctggacacaacctagcactgacggttcccgagacagcacctgggacagactgcctcttgggagagcctgaggatggcccattagaggaaccagagcctggagaattgctgactcacctgtactytcacctgaagtgtagccccctgtgccctgtgccccgcctcatcattacccctgagacccctgagcctgaggcccagccagtgggacccccctcccgggttgaggggggcagcggcggcttctcytctgcctcttctttcgacgagtctgaggatgacgtggtggccgggggcggaggtgccagcgatcccgaggacaggtctgggagcaaaccctggaagaagctgaagacagttctgaagtattcaccctttgtggtctccttccgaaaacactacccttgggtccagctttctaggagaggatggtcggattctgaaacgtttctgtcagtgtgagcagcrcagcctggagcagctgatgaaagacccgctgcgacctttcgtgcctgcctactatggcatggtgctgcaggatggccagaaccttcaaccagatggaagacctcctggctgactttgagggcccctccattatggactgcaagatgggcagcaggacctatctggaagaggagctagtgaaggcacgggaacgtccccgtccccggaaggacatgtatgagaagatg

SEQ ID NO: 130 - DNA, 629 bp; single-stranded, linear
  immediate source library: BLADTUT02
  immediate source clone: 1316844
anatgcacaaacacactcaatgaccagaccttggagaatgtcacagtgcagatggagmccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctyccggctgctgcttttggacacagtgacaatgcaggtgacagccagaagtttngaggagctnccagtagacatcatcttggcatcttg

SEQ ID NO: 131 - DNA, 301 bp; single-stranded, linear
  immediate source library: BLADNOT04
  immediate source clone: 1317663
ggctacttggagggactggtgcgcggcctgaaggccggggtgctcagccaggccgactacctcaacctggtgcagtgcgagacgctagaggattgaaatgcatctgcagagcatgattatggtaattcctggccaacgaggcatcaactctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacagg

SEQ ID NO: 132 - DNA, 655 bp; single-stranded, linear
  immediate source library: BLADNOT04
  immediate source clone: 1318463
gcgcggncagacgncagcgccatggaggagtacgctcgggagccctgcccatggcgaattgtggatgattgcggtggagccttcactatgggtgtcatcggtggcggagtcttccaggccatcaagggtttccgcaatgcccctgttggaattcggcaccggttgagaggtagtgccaatgctgtgaggatccgagccccccagattggaggtagcttcgcagtgtgggggggcctgttctncaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctatctgt

SEQ ID NO: 133 - DNA, 222 bp; single-stranded, linear
  immediate source library: BLADNOT04
  immediate source clone: 1318926
ggagctccctggtcctagcagttattttctggttggcctttgacactgccaaattgggtcaacagcagctggtgtccttcggtgggctcataatgtacattgtcctgttatttctattttccaagtacccaaccagagtttactggagacctgtcttatggggaatcgggctacagtttcttcttgggctcttgattctaaggactgaccctggatttatag

SEQ ID NO: 134 - DNA, 234 bp; single-stranded, linear
  immediate source library: BLADNOT04
  immediate source clone: 1319543
cccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctg

SEQ ID NO: 135 - DNA, 241 bp; single-stranded, linear
  immediate source library: BLADNOT04
  immediate source clone: 1320009
caagcggccacaaggntggcaggcttcgcggantcgggctgtcatcgtggctcgtggaacaatgtcggcagctgggtttgangcagcccacgcccgtgcagctcggctgcatccccgccatcctggaggaagctgtctgaggatccctatggcatcttctgcctcgtcctgacacccaccagggagctggcctaccagancgcagagcagttccgggtcctggggaagcctctagggctga

SEQ ID NO: 136 - DNA, 1956 bp; single-stranded, linear
  immediate source library: BLADNOT04
  immediate source clone: 1321876
cangagagccgaggccagagccaagactggaggcantgtctcngaccaggcgttgctctttggtgangatgatgctggtgaagggccttnttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattaysatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggratgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttcyaggattgcctgagaaatctgagtatcggmaggcagcagcttgcctgsasawytcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagmagmmrcagccaaagaagccgaaggagccacagccggaacagccacagccaagtacaagtgcaaattaactgccgtggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcagagc

SEQ ID NO: 137 - DNA, 236 bp; single-stranded, linear
  immediate source library: BLADNOT04
  immediate source clone: 1322075
cggctcgagaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccg

SEQ ID NO: 138 - DNA, 246 bp; single-stranded, linear
  immediate source library: BLADNOT04
  immediate source clone: 1322305
atcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcagtgcacaacttcatgatggatatccagtataccaaagagatgaaggagtccgctgcccgagtgctacaagaagcctggatgttctacaaacatactcgcaggaagg

SEQ ID NO: 139 - DNA, 208 bp; single-stranded, linear
  immediate source library: BMARNOT02
  immediate source clone: 132240
agtttgcttgtttgaatttctaacaggaattccccctttcaatgatgaaacaccacaacaagtattccagaatattctgaaaagagatatcccttggccagaaggtgaagaaaagttatctgataatgctcaaagtgcagtagaaatacttttaaccattgatgatacaaagagagctggaatgaaagagctaaaacgtcatcctctt

SEQ ID NO: 140 - DNA, 828 bp; single-stranded, linear
  immediate source library: BMARNOT02
  immediate source clone: 132739
gcctgaagagcggaagccttctgtcgagaagcagctacccaagctccaggagcttccgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatct

SEQ ID NO: 141 - DNA, 269 bp; single-stranded, linear
  immediate source library: PANCNOT07
  immediate source clone: 1329634
gctctggaagccaaggcagctgccttcgagaagcaggtcctgcagctgcaggcgtcccacagggagagtgaggaggccctgcagaagcgcctggacgaggtcagccgggagctgtgccacacacagagcagccacgccagcctccgggcggatgccgagaaggcccaggagcaacagcagcagatggccgagctgcacagcaagttacagtcctccgaggcggaggtgcgcanaaatgcgaggagtgagtggctccacgggcagctcca

SEQ ID NO: 142 - DNA, 263 bp; single-stranded, linear
  immediate source library: PANCNOT07
  immediate source clone: 1330522
gccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattagga

SEQ ID NO: 143 - DNA, 239 bp; single-stranded, linear
  immediate source library: BMARNOT02
  immediate source clone: 133140
caagctagaccatgaatstgmagaagkckgsswrmmystcagyskygggcasckycasctkgtgtgcctagcccgggccctgctgaggaagacgaagatccttgtgttkgatgaggccacggcagccgtggacctggaaacggacgacctcatccagtccaccatccggacacagttcgaggactkcaccgtyctyaaccatcgyccaccggctcaacaccatcatggactacacaagt

SEQ ID NO: 144 - DNA, 254 bp; single-stranded, linear
  immediate source library: COLNNOT13
  immediate source clone: 1336317
gatgaatccatagaagagcaccatttttactttaatctatctgtagnagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagat

SEQ ID NO: 145 - DNA, 252 bp; single-stranded, linear
  immediate source library: COLNNOT13
  immediate source clone: 1337114
gcctcctgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggtatggcagccgtgct

SEQ ID NO: 146 - DNA, 243 bp; single-stranded, linear
  immediate source library: COLNNOT13
  immediate source clone: 1338358
ttcatactggggagaaaccgtacagatgtcatgaatgtggtaaggacttcactcgaaattcaaacctggcaaatcatcacagaatccatactggagagaaaccgtacagatgaaatgtgtgtggtaagatctttagtaataattcacaccttgcacagcatgagataattcattcatgagagagttcttacaaactgagtatggcaaactcttcatgctaagttctagcattaatcaacatca

SEQ ID NO: 147 - DNA, 260 bp; single-stranded, linear
  immediate source library: COLNTUT03
  immediate source clone: 1340202
cctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcggg

SEQ ID NO: 148 - DNA, 294 bp; single-stranded, linear
  immediate source library: COLNTUT03
  immediate source clone: 1340712
cagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccacccccagctttggcttcgggttgcccacgtcacgggcctacgcggagtacctcggtgggtctctgcagctgcagtccctgcagggcattggcanggacgtctacctgcggntncgcanatcgatggc

SEQ ID NO: 149 - DNA, 194 bp; single-stranded, linear
  immediate source library: COLNTUT03
  immediate source clone: 1342719
ttttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttccc

SEQ ID NO: 150 - DNA, 270 bp; single-stranded, linear
  immediate source library: PROSNOT11
  immediate source clone: 1346025
ggccganctgctgtatgggctctactgcnagtntgacctcaccctctccagtcacccctcctcagttccagctatgagttcctgcnacttcacacatgcnacctttgtgcttattggtatcccaggnttagaganagcccatttctgggttggnttccccctcctttccatgtatgtagtggcaatgtttggnnactgcatcgtggtcttcatcgtaaggtcggaacgcagcctgcacgctccgatgtacctctttctctgcatgcttgc

SEQ ID NO: 151 - DNA, 256 bp; single-stranded, linear
  immediate source library: PROSNOT11
  immediate source clone: 1346050
caaaagggcaacctccttattcatcgacgtactcacactggagagaaaccctatgtatgcaatgaatgtgggaaaggcttcagccagaagacatgtttaatatcccatcagagatttcacacaggaaagacaccctttgtatgtactgagtgtggaaaatcctgctcacacaagtcaggtctcattaaccaccagagaattcacacaggagagaaaccctatacatgcagtgactgtgggaaagctttcagagata

SEQ ID NO: 152 - DNA, 269 bp; single-stranded, linear
  immediate source library: LUNGNOT09
  immediate source clone: 1354139
acctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccccgtggagcagaagctgagtgcgctgcgctccccgctggcccagaggcccttcttcgaggcgccctcaccgctgggcgccgtggacctgtacgagtacgcg

SEQ ID NO: 153 - DNA, 250 bp; single-stranded, linear
  immediate source library: LUNGNOT12
  immediate source clone: 1362803
cttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgttttt

SEQ ID NO: 154 - DNA, 183 bp; single-stranded, linear
  immediate source library: LUNGNOT12
  immediate source clone: 1363431
accgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggccc

SEQ ID NO: 155 - DNA, 240 bp; single-stranded, linear
  immediate source library: LUNGNOT12
  immediate source clone: 1363825
cggagaaaggccgtatgagtgcagggaatgtgggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattg

SEQ ID NO: 156 - DNA, 235 bp; single-stranded, linear
  immediate source library: SCORNON02
  immediate source clone: 1365530
gccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgnttccgagaccagcagtacgagatgctcaagcgntggcgccagcagcagcccgggggcctnggagccgtttacgcggccctggagcgca

SEQ ID NO: 157 - DNA, 223 bp; single-stranded, linear
  immediate source library: SCORNON02
  immediate source clone: 1366285
gcaaacctatacttttttgtatttaaaaattaatgtgaaatatgcatcatacacaatattcaatctagattccagtccatggggggatttttcctaataggaattcagggtctaaacgtgtgtatattttggctcttctgtaaatctaatgttgtgatttttatatttgtttcgttttgtctgtgaactgaataatttatacaagaacacactccattgagaa

SEQ ID NO: 158 - DNA, 246 bp; single-stranded, linear
  immediate source library: SCORNON02
  immediate source clone: 1367234
tggatgaggagtacgaggtgcctgatctggatggcactagggcccccatcaatggctgctgcagccttgatgctgagtgatcccctccagggacacttccctgcccaggccaccttccacagccctncactggtctggccagatgcactgggaacagagccacgggtnctgggtcctaganccagganttcctgtgtgaaccctgggnaaagtactaccttcctngggcttaagttttttggtttt

SEQ ID NO: 159 - DNA, 702 bp; single-stranded, linear
  immediate source library: LUNGNOT10
  immediate source clone: 1379718
ctgcgccgcaccgcccgcncgcccgctcagcgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgagagctacacccccacggtgtttgagcggtacatggtcaacctgcaagtgaaaggcaaacctgtgcacctccacatstgggacacagcagggcargawgactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagngtcggaggggctgtcccattctctgagatccccaaggcctttcctacatgcccccttcnttcacga

SEQ ID NO: 160 - DNA, 333 bp; single-stranded, linear
  immediate source library: LIVRNOT01
  immediate source clone: 138100
cagcgcatccgtggnaatgaaactatgnggaggagggcaaagtttatttctggaaggcttataaagttcatctccctcttcgtagttattcatctatatactacttaccattgcagtattcattctgaatgatcatgtggtcatcttctgcccatgaggaatagtaacgtaccacatgggggtgatgcccaagcaccgcgtgagcataaacttcatgcaaagccgaattcctatgagacagaaaagcattgaggaatgaaaacatcaatcaagataatgcacacaaaaatgtttcttaaaaatatgaggctttactagcaatggcagaatntt

SEQ ID NO: 161 - DNA, 202 bp; single-stranded, linear
  immediate source library: THYRNOT03
  immediate source clone: 1392516
ttcattgcgagattcatggcattttggcatgcttccaaagcccagagcatcattgacgcaaacgatactttgaaggacttgacgaaagtaacattgggagacaatgtgaaatactacaatttggccaggataaagtgggacccctctgatcctcaaataatatctgaaggtctttatgcaattgctgtagttttaagtttct

SEQ ID NO: 162 - DNA, 260 bp; single-stranded, linear
  immediate source library: BRAITUT08
  immediate source clone: 1398545
caatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaaca

SEQ ID NO: 163 - DNA, 249 bp; single-stranded, linear
  immediate source library: BRAITUT08
  immediate source clone: 1399470
aaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatt

SEQ ID NO: 164 - DNA, 198 bp; single-stranded, linear
  immediate source library: LATRTUT02
  immediate source clone: 1403760
ggactgcaaaaagaccttttgtcgtgtgatgcagttcactctgcacaggagaattcatactggtgaaaaaccctatgaatgcaaggaatgtggaaagtccttcagcgcccattcttctcttgttactcataagagaacacacagtggagaaaaaccgtataaatgcaaggaatgtggaaaagccttcagtgcgcactc

SEQ ID NO: 165 - DNA, 280 bp; single-stranded, linear
  immediate source library: LATRTUT02
  immediate source clone: 1403772
gcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcgganccgggcggcaggcagctccgcgccgccctggacaggtt

SEQ ID NO: 166 - DNA, 277 bp; single-stranded, linear
  immediate source library: LATRTUT02
  immediate source clone: 1405404
gctatgctggggccanancacccatgggccagggcttcctgctctcctacagccaagattggctgatgtgcctgcaggaagagtttcagtgcctgaaccaccgctgtgtatctgctgtcnagcgctgtgatggggttgangcctgtagcgatggctctgatgaagcaggttgcagctcagaccccttccctggcctgancccaagacccgtcccctccctgcnttgcaatgtcaccttggaggacttctatggggtcttctcctctcctggatatac

SEQ ID NO: 167 - DNA, 204 bp; single-stranded, linear
  immediate source library: TLYMNOR01
  immediate source clone: 140819
cacacactggggagaaaccttacgtgtgcaccaagtgtgggaaagctttcagccacagctcaaacctcaccctccactacagaacacacttggtggaccggccctatgactgtaagtttggaaaagcttttgggcagagctcagaccttcttaaacatcagagaatgcacacagaagaggcgccatatcagtgcaaagattgtt

SEQ ID NO: 168 - DNA, 263 bp; single-stranded, linear
  immediate source library: BRAINOT12
  immediate source clone: 1413041
gatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatnaggaacagccttcaaatcaaactgtccgaagacctcaggctgtcattgaagatgctgtggctacctcaggcgt

SEQ ID NO: 169 - DNA, 267 bp; single-stranded, linear
  immediate source library: BRAINOT12
  immediate source clone: 1413667
cggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggagga

SEQ ID NO: 170 - DNA, 240 bp; single-stranded, linear
  immediate source library: BRAINOT12
  immediate source clone: 1414780
acagtgctggccatggaggcggacaatcatgcacagctatcccgggcatccctaaggatccgaatcctggatgtgaacgacaatcccccagaactggccacaccctacgaggcagctgtatgcgaggatgccaagccaggccagctcatccagaccatcagcgtggtggacagagacgagccccaaggcgggcaccgcttctatttccgcctggtgcctgaagctcccagcaaccctcaa

SEQ ID NO: 171 - DNA, 240 bp; single-stranded, linear
  immediate source library: BRAINOT12
  immediate source clone: 1415728
gacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtc

SEQ ID NO: 172 - DNA, 285 bp; single-stranded, linear
  immediate source library: BRAINOT12
  immediate source clone: 1415866
ccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagcctaccactgcctcgactgcgg

SEQ ID NO: 173 - DNA, 251 bp; single-stranded, linear
  immediate source library: BRAINOT12
  immediate source clone: 1416274
agcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaag

SEQ ID NO: 174 - DNA, 262 bp; single-stranded, linear
  immediate source library: BRAINOT12
  immediate source clone: 1417215
taagaatattcatactggagagaaaccctacaaatgtaaagaatgtggcaaagcctttagacagtccaggagcctgaatgaacataaaaatattcatactggcgaaaaaccctacacatgtgaaaaatgtggcaaagcttttaaccaatcctcaagtcttattatacacaggagcattcattctgaacaaaaactttacaaatgtgaagaatgtggcaaagcctttacttggtcctcatccttaataaacataagagattcc

SEQ ID NO: 175 - DNA, 227 bp; single-stranded, linear
  immediate source library: KIDNNOT09
  immediate source clone: 1418783
gagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagta

SEQ ID NO: 176 - DNA, 778 bp; single-stranded, linear
  immediate source library: KIDNNOT09
  immediate source clone: 1419071
atgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggctaacaagacgcaatgggaaacagtggctgctgggaaaaaccttcgacaccttctgcccnctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacatagg

SEQ ID NO: 177 - DNA, 236 bp; single-stranded, linear
  immediate source library: KIDNNOT09
  immediate source clone: 1419270
atccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagag

SEQ ID NO: 178 - DNA, 263 bp; single-stranded, linear
  immediate source library: KIDNNOT09
  immediate source clone: 1419541
gctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctatt

SEQ ID NO: 179 - DNA, 234 bp; single-stranded, linear
  immediate source library: KIDNNOT09
  immediate source clone: 1419783
cgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacg

SEQ ID NO: 180 - DNA, 184 bp; single-stranded, linear
  immediate source library: KIDNNOT09
  immediate source clone: 1421907
ctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaag

SEQ ID NO: 181 - DNA, 238 bp; single-stranded, linear
  immediate source library: KIDNNOT09
  immediate source clone: 1422786
ggagagacagggaaganaagtaaggaaggtcatagtttggagatggagantgagaatcttgtagaaaatggtgcagactccgatgaagatgatnacagcttcctcaaacaacaatctccacaagaacccaagtctctgaattggtcgagttttgtagacaacacctttgctgaagaattcactactcagaatcagaaatcccaggatgtggaatctgggagggagaagtggtcaaaga

SEQ ID NO: 182 - DNA, 242 bp; single-stranded, linear
  immediate source library: SINTBST01
  immediate source clone: 1427806
ggcggttgaccaagaagcacacagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcag

SEQ ID NO: 183 - DNA, 210 bp; single-stranded, linear
  immediate source library: SINTBST01
  immediate source clone: 1429651
gagaactttacgcctggatctcatctaactgacacagaaaccctgtaaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtc

SEQ ID NO: 184 - DNA, 307 bp; single-stranded, linear
  immediate source library: SINTBST01
  immediate source clone: 1431066
cgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctnctgggcggaccttttttantcttncat

SEQ ID NO: 185 - DNA, 909 bp; single-stranded, linear
  immediate source library: THYRNOT03
  immediate source clone: 1440783
ccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatnaaagcaaaaaggctgaaggngccccaaaccagggcagaaaggcagagggnaccccaaaccagggcaaaaagacagagggnacccnaanccaagggaaaaaggcagagggaaccccaaaccaaggnaaaaaggcaganggnnccccaaaccaaggcanaanggcggagggggcccaggacca

SEQ ID NO: 186 - DNA, 244 bp; single-stranded, linear
  immediate source library: THYRNOT03
  immediate source clone: 1441850
gccaagtntgcncggaccccgtcccgancccgcngcggccatggacgcgcccgcncggctgctggccccgctcctgctcctctgcncgcanagctccgcggcaccagagcgatgaatgacatcggcgactacgngggctccaacctggagatctcctggctccccaacctggacgggctgatagccggctacgcccgcaacttccggcctggcatcggangcccccccgtgaatgtngcccttg

SEQ ID NO: 187 - DNA, 266 bp; single-stranded, linear
  immediate source library: THYRNOT03
  immediate source clone: 1443611
ggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaa

SEQ ID NO: 188 - DNA, 251 bp; single-stranded, linear
  immediate source library: PLACNOT02
  immediate source clone: 1445845
gtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcct

SEQ ID NO: 189 - DNA, 272 bp; single-stranded, linear
  immediate source library: PLACNOT02
  immediate source clone: 1446171
atgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcaccagttttaatggacttgggttccatgaatcaagcatgcatccatgtggagggtcccgccaggctctgaccctgcaggactgggcagcccagcggtgcaccatctcctaccg

SEQ ID NO: 190 - DNA, 251 bp; single-stranded, linear
  immediate source library: PLACNOT02
  immediate source clone: 1449092
ctcgagccgctttttggagcaaaggtcacaaatgagtttgttcatatcaacaacttaaaactcatctgcagagcacatcaactagtgcntgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgtttt

SEQ ID NO: 191 - DNA, 206 bp; single-stranded, linear
  immediate source library: PLACNOT02
  immediate source clone: 1449207
ctccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggag

SEQ ID NO: 192 - DNA, 250 bp; single-stranded, linear
  immediate source library: PLACNOT02
  immediate source clone: 1450036
ggaaggactcacactggggagaaaccctatgaatgtaaacagtgtggtaaagtctctcgttattggagcggccttcaggtacatgaagtaactcatattggaaaaaagctttatgaatgtaaggaatgtgggaaatcatactatagttctggttcctttctaaatcataaaaggatccacaccagggagaagtcttatgaatgcaaggaatgtgggaaagcatttggtaatcccatatcctttcaaaaac

SEQ ID NO: 193 - DNA, 255 bp; single-stranded, linear
  immediate source library: PENITUT01
  immediate source clone: 1450691
ctcaaagccatgaagatgattcgggacaacctgccaccccgactgaagaacctgcacaaggtgtcgccatccctgaagggcttcctggaccgcctgctggttcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaaganccccccggg

SEQ ID NO: 194 - DNA, 269 bp; single-stranded, linear
  immediate source library: PENITUT01
  immediate source clone: 1452972
gccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaag

SEQ ID NO: 195 - DNA, 248 bp; single-stranded, linear
  immediate source library: PENITUT01
  immediate source clone: 1454748
gttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggaaccggaaagagtttccgaagagtgaagggcagtacagtggcttcaagagtcctt

SEQ ID NO: 196 - DNA, 287 bp; single-stranded, linear
  immediate source library: COLNFET02
  immediate source clone: 1455911
agaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtattatgagttcaatattgtcaaataaggctacagtatttgcttttttgtgtgaatgtattgcatataatgttcaagtagatgattttaccatttatggnccatataaaatgtctgattaccccattt

SEQ ID NO: 197 - DNA, 255 bp; single-stranded, linear
  immediate source library: COLNFET02
  immediate source clone: 1458887
ccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggc

SEQ ID NO: 198 - DNA, 225 bp; single-stranded, linear
  immediate source library: COLNFET02
  immediate source clone: 1459432
cactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagacag

SEQ ID NO: 199 - DNA, 190 bp; single-stranded, linear
  immediate source library: LUNGTUT03
  immediate source clone: 1473889
ccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggag

SEQ ID NO: 200 - DNA, 247 bp; single-stranded, linear
  immediate source library: CORPNOT02
  immediate source clone: 1478125
aggtgagaaacccttcgactgtagtaaatgtggaaaagccttctctcaaatctcatctcttacccttcatatgagaaaacatacaggtgagaagccctatcactgtattgagtgtggcaaggctttcagccaaaagtcgcaccttgttagacaccagagaattcatactcattagaaaccctatgaatattgtgaatatggcaaggccatctgaaggaattaacacctcattgcacattacatgatc

SEQ ID NO: 201 - DNA, 233 bp; single-stranded, linear
  immediate source library: CORPNOT02
  immediate source clone: 1478654
acttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactctggtggtattttggctgttacttttgtttgcccacgcttttcaccatca

SEQ ID NO: 202 - DNA, 255 bp; single-stranded, linear
  immediate source library: CORPNOT02
  immediate source clone: 1484393
agaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaa

SEQ ID NO: 203 - DNA, 230 bp; single-stranded, linear
  immediate source library: CORPNOT02
  immediate source clone: 1485091
ccaatgttgtccggctgatggacgtctgtgccacatcccgaactgaaccgggagatccaggtaaccctggagtatgagcatntagaccagnacctaangacanatcnngacaaggnacccccaccaggcttaccagccgaaaacgatcaaggntctgangcgcnatttctaagaggcctagattncantcatgacaattgcancgttcancnagatatgaagccngagaa

SEQ ID NO: 204 - DNA, 251 bp; single-stranded, linear
  immediate source library: FIBRNGT01
  immediate source clone: 148732
ggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagngtccacacggggggaaaagccatacaaatgt

SEQ ID NO: 205 - DNA, 274 bp; single-stranded, linear
  immediate source library: BRSTNOT08
  immediate source clone: 1488082
cttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaatgattccgactggatggtctgtggagggggcccagccctcaccctctggcactc

SEQ ID NO: 206 - DNA, 393 bp; single-stranded, linear
  immediate source library: PROSNON01
  immediate source clone: 1491965
gtgcgcctgccccaacccgtgcgccagcacgcgctacgccaaggagctctccatggtgcggatcccgagccgcgccgccgcgcgcttcctggcccggaagctcaaccgcagcgaggcctacatcgcggagaacgtgctggccctggacatcttctttgaggccctcaactatgagaccrtkgarcagaagaaggcctatgagatkkcagrgctsctkggtgacatygggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgt

SEQ ID NO: 207 - DNA, 267 bp; single-stranded, linear
  immediate source library: FIBRNGT02
  immediate source clone: 149706
gagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgncagcttccgcggagccnttcctcggacctgggctncaagttttagggaggccgaggagacggcanaag

SEQ ID NO: 208 - DNA, 257 bp; single-stranded, linear
  immediate source library: SINTBST01
  immediate source clone: 1499408
gtatttctacaagtatttccgggatgagaggagggccgagcgcgcctaccgcttcgtgaaggagaacgagacgctgttcgcgctgtgcttcgtgcccttcgtgtgctggatcgtgtgcaccgtgctgcgccanantgngagctcggtcgggacctgtcgcgcacgtccaagaccaccacgtcagtgtacctgcttttcatcaccagcgttctgagctcggctccggtagccgacgggccccggttgcagggcgacct

SEQ ID NO: 209 - DNA, 166 bp; single-stranded, linear
  immediate source library: FIBRANT01
  immediate source clone: 150224
agcccgtgtgaacccattgcctgcactaaccccctttcttctcctttcagcggtcggattcattataaggatatgtacagtttattacgagtaatatctccccctctcggcttaggcaagaaatgtcctcatagggttgcttgcaaggtttgacttccactaaaag

SEQ ID NO: 210 - DNA, 196 bp; single-stranded, linear
  immediate source library: BRAITUT07
  immediate source clone: 1506560
gcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcat

SEQ ID NO: 211 - DNA, 207 bp; single-stranded, linear
  immediate source library: PANCTUT01
  immediate source clone: 1513769
gaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagag

SEQ ID NO: 212 - DNA, 224 bp; single-stranded, linear
  immediate source library: PANCTUT01
  immediate source clone: 1513871
acctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttg

SEQ ID NO: 213 - DNA, 212 bp; single-stranded, linear
  immediate source library: PANCTUT01
  immediate source clone: 1515432
cggctcgagctggaattaaggtcatcatggtcacaggagaccatccaatcacagctaaagtattgccaaaggtgtgggcatcatctcagaaggcatgagaccgtggaagacattgctgcccgcctcaaacatccccagtcagcaagtgaaccccagggatgccaaggcctgcgtagtacacggcattgattctaaaggacatgacctccggg

SEQ ID NO: 214 - DNA, 172 bp; single-stranded, linear
  immediate source library: BLADTUT04
  immediate source clone: 1518859
tgtgactacagctgttccagtggctaccacctggaaggtgatcgcagccgaatctgcatggaagatgggagatggagtggaggcgagcctgtatgtgtagacatagatccccccaagatccgctgtccccactcacgtgagaagatggcagagccagagaaattgactgctc

SEQ ID NO: 215 - DNA, 188 bp; single-stranded, linear
  immediate source library: BLADTUT04
  immediate source clone: 1519420
agagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagc

SEQ ID NO: 216 - DNA, 200 bp; single-stranded, linear
  immediate source library: BLADTUT04
  immediate source clone: 1520835
tcttgagcccccaggagccagggatgtggaggcgcantgcggcggctgcaggaggagaggacgtgcaaggtgtgcctggaccgcgccgtgtccatcgtctttgtgccgtgcggccacctggtctgtgctgantgtgccccgggcnnnaancttncccccatttgnaaggcccccntttccnnaaaacggntttggaaact

SEQ ID NO: 217 - DNA, 198 bp; single-stranded, linear
  immediate source library: BLADTUT04
  immediate source clone: 1522516
aaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctga

SEQ ID NO: 218 - DNA, 192 bp; single-stranded, linear
  immediate source library: BLADTUT04
  immediate source clone: 1522554
agacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtgg

SEQ ID NO: 219 - DNA, 200 bp; single-stranded, linear
  immediate source library: UCMCL5T01
  immediate source clone: 1524781
tgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgcta

SEQ ID NO: 220 - DNA, 207 bp; single-stranded, linear
  immediate source library: UCMCL5T01
  immediate source clone: 1525902
ggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgct

SEQ ID NO: 221 - DNA, 865 bp; single-stranded, linear
  immediate source library: UCMCL5T01
  immediate source clone: 1525913
gacggctcgagtggaggtctcagactcttggaaggggctatactagacacacaaagacagccccaagaaggacggtggagtagtgtcctcgctaaaagacagtagatatgcaacgcctcttgctcctgccctttctcctgctgggaacagtttctgctcttcatctggagaatgatgccccccatctggagagcctagagacacaggcagacctaggccaggatctggatagttcaaaggagcaggagagagacttggctctgacggaggaggtgattcaggcagagggagaggaggtcaaggcttctgcctgtcaagacaactttgaggatgaggaagccatggagtcggacccagctgccttagacaaggacttccagtgccccagggaagaagacattgttgaagtgcagggaagtccaaggtgcaagacctgccgctacctattggtgcggactcctaaaacttttgcagaagctcagaatgtctgcagcagatgctacggaggcaaccttgtctctatccatgacttcaacttcaactatcgcattcagtgctgcactagcacagtcaaccaagcccaggtctggattggaggcaacctcaggggctggttcctgtggaagcggttttgctggactgatgggagccactggaattttgcttactggtccccagggcaacctgggaatgggcaaggctcctgtgtggccctatgcaccaaaggaggttattggcgacgagctcaatgcgacaagcaactgcccttcgtctgctccttctaagccagcggcacggagaccctgccagcagctccctcccgtcccccaacctctcctgctcataaatccagacttcccacagc

SEQ ID NO: 222 - DNA, 249 bp; single-stranded, linear
  immediate source library: SPLNNOT04
  immediate source clone: 1531264
tggagcttggtttcgggatctcggtgctgcagacggcgagacctcctgcacagggtgtacagcaagctgtgattcctgggaaaacnaaaaaagctctctggacaacggggcccagagctgatggcagacaatgtcagccactaacaacatagcccaggcccggaagctggtggaacagctacgcatagaagccgggattgagcgcatcaaggtctccaaagcggcgtctgacctcatgagctactgtga

SEQ ID NO: 223 - DNA, 214 bp; single-stranded, linear
  immediate source library: SPLNNOT04
  immediate source clone: 1534444
cagcactggcctgacgtggcggtcgggcacggcgagctccgtgtcttatccaaagcagatgccattgtcccaggtctgancngangggagggggcgcccagnnngngtnnngangggggcgaggagacccaagtgcagcgaagggacacttgatgggctgaggttcccaccccttcacagtgttgattgctattagcatgataatgaactctta

SEQ ID NO: 224 - DNA, 205 bp; single-stranded, linear
  immediate source library: SPLNNOT04
  immediate source clone: 1534638
tccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcacca

SEQ ID NO: 225 - DNA, 204 bp; single-stranded, linear
  immediate source library: SPLNNOT04
  immediate source clone: 1535355
tggatggcaaagactgtcagagcttcttctgctgctatgaagaatgtaaatcaggatcctggaggaaagggcgtattcacatagacatcttggagctggactcgtactcccgggtctttttccccacgtccttcctgctctttaacctggtctactgggttggatacctgtatctctaagtgttgctcagagtgaagagtgaag

SEQ ID NO: 226 - DNA, 202 bp; single-stranded, linear
  immediate source library: PROSTUT04
  immediate source clone: 1542751
tccgangccgtgagcgcaaagcctcaggccccggctccctcctgagctgcgccgtgccaggccgcccgccgggatgcagtgggccgtgggccggcggtgggcgtgggccgcnctgctcctggctgtcgcagcggtgctganccaggtcgtctggctctggctgggtacgcagagcttcgtcttccagcgcgaagagatagcg

SEQ ID NO: 227 - DNA, 167 bp; single-stranded, linear
  immediate source library: PROSNOT06
  immediate source clone: 1552350
gagccatttaaaactgaagccaataaggggaactttctggagatgaaaaataagttcctggcccggaggttcaagctcctggagcaggcgctggtgattgaggacactgggcgggcggctactaacttgagagcgcgaccgcatgcctcagcgttgcgagcgaggct

SEQ ID NO: 228 - DNA, 213 bp; single-stranded, linear
  immediate source library: BLADTUT04
  immediate source clone: 1556277
ctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagac

SEQ ID NO: 229 - DNA, 227 bp; single-stranded, linear
  immediate source library: SPLNNOT04
  immediate source clone: 1559036
gctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggccngctaccagctctgtggcctcaatgcaatttggttctataccaacagcatctttgg

SEQ ID NO: 230 - DNA, 1482 bp; single-stranded, linear
  immediate source library: SPLNNOT04
  immediate source clone: 1561663
cggcgctgtgagtgccacgcaggctacgtaggcgatggactgcagtgtctggaggagtcggaaccacctgtggaccgctgcttgggccagccaccgccctgccactcagatgccatgtgcactgacctgcacttccaggagaaacgggctggcgttttccacctccaggccaccagcggcccttatggtctgaacttttcggaggctgaggcggcatgcgaagacagggagccgtccttgcttcattccctcagctctctgctgcccagcagctgggcttccacctgtgcctcatgggctggctggccaatggctccactgcccaccctgtggttttccctgtggcggactgtggcaatggtcgggtgggcatagtcagcctgggtgcccgcaagaacctctcagaacgctgggatgcctactgcttccgtgtgcaagatgtggcctgccgatgccgaaatggcttcgtgggtgacgggatcagcacgtgcaatgggaagctgctggatgtgctggctgccactgccaacttctccaccttctatgggatgctattgggctatgccaatgccacccagcggggtctcgacttcctggacttcctggatgatgagctcacgtataagacactcttcgtccctgtcaatgaaggctttgtggacaacatgacgctgagtggcccagacttggagctgcatgcctccaacgccaccctcctaagtgccaacgccagccaggggaagttgcttccggcccactcaggcctcagcctcatcatcagtgacgcaggccctgacaacagttcctgggcccctgtggccccagggacagttgtggttagccgtatcattgtgtgggacatcatggccttcaatggcatcatccatgctctggccagccccctcctggcacccccacagccccaggcagtgctggcgcctgaagccccacctgtggcggcaggcgtgggggctgtgcttgccgctggagcactgcttggcttggtggccggagctctctacctccgtgcccgaggcaagcccacgggctttggcttctctgccttccaggcggaagatgatgctgatgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctnagggcctgttccagacaaataaaggttncctnaagcggattgttgggccatgtnaaccaaaaaaaannnnnnnnanaaaaaaggggcggcccgttttgggggttcccaggtttanggtacgggtngaattggacggtaatagntnttnttttagngt

SEQ ID NO: 231 - DNA, 2201 bp; single-stranded, linear
  immediate source library: THP1PLB02
  immediate source clone: 156196
cgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggttgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaggcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcaraccagagctccttggtcctttcagtrcwaggcagnanacagcccccgatctgyatagcctgtgaaagcccrcggggacatcagtaaccttctkcagccaccatccaatgccattactgtcaagtgagacttggccmctgtarcctgggcctkctkcaggagctcttcagaaaggcacatkaggaccacggntttsgctcagtttctggtaaaacacaaggtctggagtkcccctgcmaagggtattgatggacttcctkccagtgacagagcatgtctatttccaacaattctctcanttacgttcaacacttaagaacggctaatggcaataggatctttaacaactttttcacatcanagnaggttcaatcgctcacttgggnacacnactgagagtgacttctcttttaaaattgagtaacagatggaaaaataaaatttggacttgattattaanatcccn

SEQ ID NO: 232 - DNA, 217 bp; single-stranded, linear
  immediate source library: SPLNNOT04
  immediate source clone: 1562022
atgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgt

SEQ ID NO: 233 - DNA, 199 bp; single-stranded, linear
  immediate source library: UTRSNOT05
  immediate source clone: 1567861
atcaatgccagctgcgtggaggggctctccccatactgccccccgctagtggcaacccaggccccactgcctggcacagctgctgacttctggctcatggtccatgagcagaaagtgtcagtcattgtcatgctggtttctgaggctgagatggagaagcaaaaagtggcacgctacttccccaccgagaggggccagc

SEQ ID NO: 234 - DNA, 200 bp; single-stranded, linear
  immediate source library: UTRSNOT05
  immediate source clone: 1568973
agctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctcct

SEQ ID NO: 235 - DNA, 201 bp; single-stranded, linear
  immediate source library: UTRSNOT05
  immediate source clone: 1571294
atcgcgatgaggcttcggaaccagctccagtcagtgtacaagatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaa

SEQ ID NO: 236 - DNA, 226 bp; single-stranded, linear
  immediate source library: UTRSNOT05
  immediate source clone: 1571739
gaatgatgtgaagcttgctgtcttgggtggtgaaggaacaggcaaatctgcccttacagtgaggtttcttactaagcgattcattggagaatatgcttctaattttgaatctatctataagaagcacttgtgtttggaaaggaaacaactaaatctagaaatatatgacccttgttctcaaacacagaaagcaaaattctccctcacaagtgagcttcactgggcg

SEQ ID NO: 237 - DNA, 216 bp; single-stranded, linear
  immediate source library: LNODNOT03
  immediate source clone: 1577179
gttcatatcacatttgatggctggagtggagcttttgattactggtgcaagtatgattctcgagatattttcccagctgggtggtgtcgcctgacaggagatgtattacaacccccaggaactagtgttcctattgtaaagaatatagcaaaaacagagtcttctccttccgaagcaagccagcattcaatgcagtctccacagaaaactactcta

SEQ ID NO: 238 - DNA, 349 bp; single-stranded, linear
  immediate source library: DUODNOT01
  immediate source clone: 1582344
cggctcgaggcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaa

SEQ ID NO: 239 - DNA, 179 bp; single-stranded, linear
  immediate source library: ADENINB01
  immediate source clone: 158840
gggaagcgctgtgcgctaccaggcggagccaacagctcgttcgtggcccanagggaggagaacgtgcccaagaaccgttccntggccgtnntgacctatnaccactcccggntcctgctgaaggcggagaacagccacagccactcagactacatcaacgctagccccatnatggttct

SEQ ID NO: 240 - DNA, 981 bp; single-stranded, linear
  immediate source library: ADENINB01
  immediate source clone: 158909
cgcctataatgagacagtaaaattcttttactctgggaaaaataaaatgctgggtgtctcacaaaatttcagaacctgatttcaaacggatcataacaaagaggagatcaaatttagcatggtggactgctcgacaggatacatttgtcaatggaatgtttccacatattataccaccaacatgagaaaaaaatgatcattgtttatttgaagcttgaaaaatgagcaggcggaattgttggatttgtaaaatgtgcagaaataaatctaagaggcccccttcaaaccttaccttggaggaagtattacggtgggcccagtcttttgaaaatttaatggctacaaaatatggtccaattatctatgccgcatatttaaaaacggaacacagtgaccaaaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggacaaggaaggtcttcttcatgatacaagcattataaagtttttactg

SEQ ID NO: 241 - DNA, 221 bp; single-stranded, linear
  immediate source library: BRAINOT14
  immediate source clone: 1594203
gctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggt

SEQ ID NO: 242 - DNA, 146 bp; single-stranded, linear
  immediate source library: BRAINOT14
  immediate source clone: 1595261
ccacgtttcctttcctttcccttcctttcctccctccctgataccaactcgcgccctgtccctccacctcccactccagatccgggtggtgaaagcgttccgtagctcgctctatgaaggcctggagaaaccagattcaaagacct

SEQ ID NO: 243 - DNA, 213 bp; single-stranded, linear
  immediate source library: BRAINOT14
  immediate source clone: 1595550
gaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaata

SEQ ID NO: 244 - DNA, 225 bp; single-stranded, linear
  immediate source library: BLADNOT03
  immediate source clone: 1599448
ggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaacta

SEQ ID NO: 245 - DNA, 204 bp; single-stranded, linear
  immediate source library: BLADNOT03
  immediate source clone: 1602048
gccgccntcaacaaggatgccctgctcaactggctgaagtccaagaacccgggggaggccctggatcgagccattgaggagttcaccctctcctgtgctggcnanngtgtngggcnaaaangtgctggcatttggcgatcggcacagcgacaacatcatgatccgagagagtgggcagctgttccacattgattttggccactt

SEQ ID NO: 246 - DNA, 181 bp; single-stranded, linear
  immediate source library: ADENINB01
  immediate source clone: 160377
cagaagcctaacctgtttaggcacaagagggcacactcaggtgcctttttttgtagggagtntgggcaaggcttttttnctaagttaactctcattaaacaccagagagcacacgcaggggggaagcctcatgtntgcagggagtntgggcaaggctttagccgncagtcacacctcattt

SEQ ID NO: 247 - DNA, 208 bp; single-stranded, linear
  immediate source library: COLNTUT06
  immediate source clone: 1609593
tccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctggggg

SEQ ID NO: 248 - DNA, 221 bp; single-stranded, linear
  immediate source library: COLNTUT06
  immediate source clone: 1611858
ggctttttgattatgcaagacaaatgcaaaagttacctgttgctattccagcacacaaactccctggacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaacc

SEQ ID NO: 249 - DNA, 204 bp; single-stranded, linear
  immediate source library: COLNTUT06
  immediate source clone: 1613615
cccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggg

SEQ ID NO: 250 - DNA, 206 bp; single-stranded, linear
  immediate source library: BRAITUT12
  immediate source clone: 1614664
gatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacactccnagtnaantttccncaaggngaaaccaatcanacaag

SEQ ID NO: 251 - DNA, 212 bp; single-stranded, linear
  immediate source library: BRAITUT12
  immediate source clone: 1617511
gcgaaaccgatacttcatcagccttcagcagcctcctgccccggcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaa

SEQ ID NO: 252 - DNA, 738 bp; single-stranded, linear
  immediate source library: BRAITUT13
  immediate source clone: 1620089
cggcgctggacccnacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttngaagaaggcctgccaggwgacccagtcgcggaacggaagaccatgaccacakcccacctgaagcagtgcatcgagctggagcagcagtttgactkcktgaaggacctggtggcatckgttacccgacatgcagggggacggggaagacaaccacatggatggggacaagggcgcccgcagggccggaagccaggcagcggcggccggaagaacggtgggatgggaacgaaaagcaaggacaagaagctktccgggacagactcggagcaggaggatgaatctgaggacacagatactgatggggaagaggagacatcacancccccacccgcaggccagccacccctctgcccactttcagagccccccgacaaccttcctgcccttcgcctctactctgcctttgcccccagcgcccccgggcccctcagcacctgatgaagaggacgaagaagattacgactnctagcgccttctgccccccagaccatagccccttttagttggttttagttgctctggggggaggagagaaggtagagctgttcttaa

SEQ ID NO: 253 - DNA, 202 bp; single-stranded, linear
  immediate source library: COLNPOT01
  immediate source clone: 1627314
gcgtagggcccgccaccggctgctctctggggactcaacagagaagcgcactgctcgccctgtcaacaaagtgatcaagtccgcctcagccacagccctctcactcctcattccttcgggtgaggcccctggggagctgggataaaactcacaggaagggccttgtaatctctaggccttgggagggttctgcacgtggcag

SEQ ID NO: 254 - DNA, 787 bp; single-stranded, linear
  immediate source library: COLNPOT01
  immediate source clone: 1627393
aaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagtggggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctncatgccatt

SEQ ID NO: 255 - DNA, 227 bp; single-stranded, linear
  immediate source library: COLNNOT19
  immediate source clone: 1631444
gttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagag

SEQ ID NO: 256 - DNA, 224 bp; single-stranded, linear
  immediate source library: COLNNOT19
  immediate source clone: 1633025
aaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaa

SEQ ID NO: 257 - DNA, 214 bp; single-stranded, linear
  immediate source library: UTRSNOT06
  immediate source clone: 1638409
gcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatcctt

SEQ ID NO: 258 - DNA, 219 bp; single-stranded, linear
  immediate source library: UTRSNOT06
  immediate source clone: 1640136
tctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagctt

SEQ ID NO: 259 - DNA, 217 bp; single-stranded, linear
  immediate source library: HEARFET01
  immediate source clone: 1644169
gccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactgga

SEQ ID NO: 260 - DNA, 234 bp; single-stranded, linear
  immediate source library: PROSTUT09
  immediate source clone: 1650213
gtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgc

SEQ ID NO: 261 - DNA, 184 bp; single-stranded, linear
  immediate source library: PROSTUT09
  immediate source clone: 1650519
caattcaggcaacaggagcgacgggccaggaaagaacaccacccttcacaatgaatttgacacaattgtcttgccggtgctttatctcattatatttgtggcaagcatcttgctgaatggtttagcagtgtggatcttcttccacattaggaataaaaccagcttcatattctatctcaaaaag

SEQ ID NO: 262 - DNA, 247 bp; single-stranded, linear
  immediate source library: BRSTNOT09
  immediate source clone: 1661781
gtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaaganactcctcaagggcctcttccggcagggcctgcaatgcaaagactgcaagtttaactgtcacaaacgctgcgccacccgcgtccctaatgactgcct

SEQ ID NO: 263 - DNA, 221 bp; single-stranded, linear
  immediate source library: BRSTNOT09
  immediate source clone: 1663527
gcagatcaagaagatcaaagaagtgatcgacctgcctgctaagcatcccganctcttcaaagcactgggcattgcacagcccaagggaatgctgcttggaagagactgttggcctgggctctggctcatcatagggactgtgtaccttnattcatgtctctggctctgaattggtacagaaattcattggggaatttctgtgatggcagagaaaatgctca

SEQ ID NO: 264 - DNA, 888 bp; single-stranded, linear
  immediate source library: LIVRNOT01
  immediate source clone: 166395
gtccctataaagcgtgctggtgtgggcccgaccctcaaagcttcagatttaccaacagcatgaatcaagaaaagttagccgaactccnntgctcaagtccggatanggggcaagggtacanctcgcanaaagaanaaggtggtacatagaacagccacagctgattattaaaagcttcagagttctctaaaaaaactggctgtgaataatatagctggtattgaagaggtgaacatgattaaagatgatgggacagttattcatttcaacaatcccnaagtccaagcttccctttctgctaatacctttgcaattantggtcntgcagaagccaaaccaatcacagaaatgcttcctggaatattaagtcagcttggtgctgacagtttaacaagccttaggttcccacggcaagttttggacantaaagcancaaaaccagaagacattgatgaaggaaagatgatnatgttccagatcttgtntnaaaaattttgatgaaggcatccanagaaatgaaagcttaactaaaattttggtttttttgggaaacctggcattngaactanaattttaaccaaatccagcttatgttggttccccnaaattttttacngaacattgggaaaaacatccaccctgtttactaatttccaattnaataataaatattttgtttatatttaataatgcctgttttgtttccaccatttttccgtccatttaaatttgcatttttgccttcccccccccngaaanatttttttggtcccnaaatttaaatttttggtgccnttttaanggtnttttttgggtttttnaatccccnggttttttttngtttttttgtttgggggtaanttgggggtaaggttaggtttaagtnan

SEQ ID NO: 265 - DNA, 229 bp; single-stranded, linear
  immediate source library: BRSTNOT09
  immediate source clone: 1665830
gccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaa

SEQ ID NO: 266 - DNA, 201 bp; single-stranded, linear
  immediate source library: PROSNOT15
  immediate source clone: 1683253
cccaggctgacaacacatctcaatatgaccgtgctggtgtcggacgtcaatgacaacgcccccgccttcacccaaacctcctacaccctgttcgtccgcgagaacaacagccccgccctgcacatcggcagcgtcangccacagacagagactcgggcaccaacgcccaggtcacctactcgctgctgccgccccaggatc

SEQ ID NO: 267 - DNA, 239 bp; single-stranded, linear
  immediate source library: PROSNOT15
  immediate source clone: 1683908
gtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgattcctcatgcca

SEQ ID NO: 268 - DNA, 198 bp; single-stranded, linear
  immediate source library: PROSTUT10
  immediate source clone: 1687189
cggctcgagctgatgatgccttactaccagcttcagcctgagagccctttgcctgangcatttctctacattggatgggctcctgcccgcnatgttgtggctgttggctccctctgtgctctttctaccagcctcctgggctccatgttccccatgcctcgggtgatctacgcgatggcagaggatggcctcctgttc

SEQ ID NO: 269 - DNA, 219 bp; single-stranded, linear
  immediate source library: PROSTUT10
  immediate source clone: 1689047
ctgtccccccacagctgagcttcctgccaccgccctggggcgattgcagttcagcatctctganccccaactatgagccagagccctctgancccctaggctccccaagccccagccccagccctccctatacccttatggggtgtcgcctggcctgcgaaacccgctacgtggctcggaagtgcggctgccgaatggtgtacatgccaggcgacgtgc

SEQ ID NO: 270 - DNA, 605 bp; single-stranded, linear
  immediate source library: PROSTUT10
  immediate source clone: 1692213
gcggttcagcgttcracaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaaganagggtgggg

SEQ ID NO: 271 - DNA, 253 bp; single-stranded, linear
  immediate source library: COLNNOT23
  immediate source clone: 1695770
ggatggctgtgtgtctgctctttgtgttcgctgccttgctggagtatgctgccataaattttgtttctcgtcagcataaagaattcatacgacttcgaagaaggcagaggcgccaacgcttggaggaagatatcatccaagaaagtcgtttctatttccgtggctatggcttgggccactgcctgcaggcaagagatggaggtccaatggaaggttctggcatttatagtccccaacctccagcccctcttct

SEQ ID NO: 272 - DNA, 226 bp; single-stranded, linear
  immediate source library: COLNNOT23
  immediate source clone: 1696636
gcccagaaggagttcataaagaatacaaagaagaccccaaaagatgtcacgatggcactattgaattcacgagcatcgatgcacacaatggcgtggccccatcaagacgtggtgatttggaaatacttggttattgcatgatccaatggcttactggccatcttccttgggaggataatttgaaagatcctaaatatgttagagattccaaaattagatacagaga

SEQ ID NO: 273 - DNA, 227 bp; single-stranded, linear
  immediate source library: BLADTUT05
  immediate source clone: 1698367
ggagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgctt

SEQ ID NO: 274 - DNA, 204 bp; single-stranded, linear
  immediate source library: BLADTUT05
  immediate source clone: 1698521
ctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtgg

SEQ ID NO: 275 - DNA, 192 bp; single-stranded, linear
  immediate source library: BMARNOR02
  immediate source clone: 170173
aagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttg

SEQ ID NO: 276 - DNA, 237 bp; single-stranded, linear
  immediate source library: PROSNOT16
  immediate source clone: 1711051
ggaagacctccaggatggagaagtgaggctgggtggctccctgcgaggggcattcagcaacaatgagagaattaaaaacttcttcagagtcagtttcaaaaacggatcccaaagtcagacccactcgctacaagccaatgacactttcaacaaacagcagtggcttaactgtattcgtcaagccaaagaaacagttctgtgtgctgccgggcaagctggggtgcttgactccgaggg

SEQ ID NO: 277 - DNA, 221 bp; single-stranded, linear
  immediate source library: BMARNOR02
  immediate source clone: 171185
tccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgg

SEQ ID NO: 278 - DNA, 280 bp; single-stranded, linear
  immediate source library: UCMCNOT02
  immediate source clone: 1714778
gaacacttggccctgagcctatttcctgatgttttagaaaacaaatatggatatagcctgtgtttgcttgaaagagatgtggctccaggaggagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattangtctgttacttccaagagccagagtctctacc

SEQ ID NO: 279 - DNA, 253 bp; single-stranded, linear
  immediate source library: UCMCNOT02
  immediate source clone: 1715239
gcaggtggaaaatgagcttatatatgaagaagtcagcgagtggacaaagccaggcgcaatggatagcaaagatgtggaagtctcctcgattcaagttagaagaaaaccgcagcatggagtctgctctcagctgttggggaattaccgatgcctttgactaagtcaagactgacttttccagaatatcacccaagagatagagccgtccctgtccaagtttgtgcgctanccttcatggaggtcagagaggaag

SEQ ID NO: 280 - DNA, 224 bp; single-stranded, linear
  immediate source library: BMARNOR02
  immediate source clone: 171540
tgctgccttctcaatgttgacctttaaccaccttttcaatctaccctgtggtaactggtatgtttgttttttgagaaaacgttttgctctgtcacccaggctggagtgcaatggcacaatcacagctcactgcggccttgacctgctgggtttaagtgatgcttccatatcacgcctgtnaccccagcactctgggaggctgaggtgggcagattatgaggtca

SEQ ID NO: 281 - DNA, 195 bp; single-stranded, linear
  immediate source library: BLADNOT06
  immediate source clone: 1718820
attcgtcacctggggaatggggcctgcgcccatgaccagctggaggtgattganctggacaactgcccactaatcacagatgcatccctggagcacttgaagagctgtcatagccttgagcggatagaactctatgactgccagcaaatcacacgggctggaatcaagagactcaggacccatttacccaatatt

SEQ ID NO: 282 - DNA, 113 bp; single-stranded, linear
  immediate source library: BLADNOT06
  immediate source clone: 1719418
attggtcaaaaatcaactgcagcgatggttacattgaatactacatatgtcgagggaatgcagaaagagttaaggaaggcaggttgtccttctattcaggccactcttcgttt

SEQ ID NO: 283 - DNA, 778 bp; single-stranded, linear
  immediate source library: BLADNOT06
  immediate source clone: 1721611
cgcggcagctcccaccatggcggagaccaagctccagctgtttgtcaaggcgagtgaggacggggagagcgtgggtcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagtgcgcggcgtacgccgttacctggacagcgcgatgcaggagaaagagttcaaatacacgtgtccgcacagcgccgagatcctggcggcctaccggcccgccgtgcaccccacgctagcgccccaccccgcgtctgtcgcccaataaaggcatctttgtcgggaaaaaa

SEQ ID NO: 284 - DNA, 1584 bp; single-stranded, linear
  immediate source library: BLADNOT06
  immediate source clone: 1722180
gggactgactaaatgtcagcaagaggagagtctcaccctgttgcttaggcagatggcgcgatctcggctcctgggttcaagcaattctcctgcctcagcctcctgaatagccgggattacagtcgtccagcatgctctgcccaccccacgccgaggtgcactgaccatgagcctcaactcctccctcagctgcaggaaggagctgagtaatctcactgagggggagggtggcgaagggggcgtcatcatcacccagttcatcgccatcattgtcatcaccatttttgtctgcctgggaaacctggtcatcgtggtcaccttgtacaagaagtcctacctcctcaccctcagcaacaagttcgtcttcagcctgactctgtccaacttcctgctgtccgtgttggtgctgccttttgtggtgacgagctccatccgcagggaatggatctttggtgtagtgtggtgcaacttctctgccctcctctacctgctgatcagctctgccagcatgctaaccctcggggtcattgccatcgaccgctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccggcgtccggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggcggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaacttcgattcttcatgtgaaagctgaagtacacaagtccttggacagttacgcagcaagcttggccaaagccattgagg

SEQ ID NO: 285 - DNA, 202 bp; single-stranded, linear
  immediate source library: BLADNOT06
  immediate source clone: 1723064
gtactatcacgtgcagssycactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccacc

SEQ ID NO: 286 - DNA, 217 bp; single-stranded, linear
  immediate source library: PROSNOT14
  immediate source clone: 1723675
gcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccat

SEQ ID NO: 287 - DNA, 299 bp; single-stranded, linear
  immediate source library: BRSTTUT08
  immediate source clone: 1732084
caagcctgccaacatcttcctggggccccggggccgctgcaagckgskygagcttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacntgccccctgagttcactgccggtctgtcttcngagctgngg

SEQ ID NO: 288 - DNA, 219 bp; single-stranded, linear
  immediate source library: COLNNOT22
  immediate source clone: 1734452
gtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggagga

SEQ ID NO: 289 - DNA, 472 bp; single-stranded, linear
  immediate source library: BMARNOR02
  immediate source clone: 173693
ctggtgttggaggaccctccctgcttcanatttaccaacagcatgaatcaagaaaagttagccaaacttcaggctcaggtccggatagggggcaagggtacagctcgcagnaagaagaaggtggtacatagancanccacagctgatgacaaaaaagccttcatgacgttctctaaaaaaacttggcttgtgaataatatagctggtattkaagaggtgaacatgatttaaagatgattgggacagttattcatttymacaatcccaaagtccaagcttccctttctgctaatacctttgcaattactggtcatgcagaagccaaaccaatcacaganatgcttcctgggatattaaggtcagctttggtgctgaccagtttnacaagccttaggaaggttagcttgnacagttcccangggcaaagttttggnccagtaaaagcacccaaatnccagtagggccatttgtt

SEQ ID NO: 290 - DNA, 232 bp; single-stranded, linear
  immediate source library: COLNNOT22
  immediate source clone: 1737775
cggctcgaggaaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgtttgaag

SEQ ID NO: 291 - DNA, 236 bp; single-stranded, linear
  immediate source library: STOMTUT02
  immediate source clone: 1746096
tgtgccaggccaagtcgggcatgggaaananagcagtgtttgtnttggccacactgcaacagctggagccagttactgggcaggtgtctgtgctggtgatgtgtcacactcgggagttggttttcagatnagcaaggaatatgagcgcttctctaaatacatgcccaatgtcaaggttgctgttttttttggtggtctgtctatcaagaaggatgaagaggngctgaagaagaaac

SEQ ID NO: 292 - DNA, 264 bp; single-stranded, linear
  immediate source library: STOMTUT02
  immediate source clone: 1749008
ggaggagagctggtcctggggggctcagacccggcacactacatcccacccctcaccttcgtgccagtcacagtccccgcctactggcagatccacatggagcgtgtgaaggtgggctcacggctgactctctgtgcccagggctgtgctgccatcctggatacaggcacacctgtcatcgtaggacccactgaggagatccgggccctgcatgcagccattgggggaatccccttgctggctggggagtacatcatccggtgc

SEQ ID NO: 293 - DNA, 224 bp; single-stranded, linear
  immediate source library: LIVRTUT01
  immediate source clone: 1751294
caaagagctcagctcccactggcggcccaaggatgtggtcgtggtggcactggggctgaccgtcagcgtgctggtgctgctgaccaatctgctggtcatagcagccatcgcctccaaccgccgcttccaccagcccatctactacctgctcggcaatctngccgcggctgacctcttcgcgggcgtggcctacctcttcctcatgttccanactggtccccgca

SEQ ID NO: 294 - DNA, 227 bp; single-stranded, linear
  immediate source library: LIVRTUT01
  immediate source clone: 1755202
cagcaatgtggagcaattttctgagggcaacattgatgtgtggtggattgtgcatganggggggatgcttatgctactaccattcctactgaaacagcacaaggtgtggcgaaagtgcagcatacggatcttcacagtagcccaattagaagacaacagtatccaaatgaagaaggacctagccaccttcctatatcacttacgcattgaggcggaggtagaagtgg

SEQ ID NO: 295 - DNA, 361 bp; single-stranded, linear
  immediate source library: TLYMNOT01
  immediate source clone: 176843
ttgacctcatcaacaacctgctgcaggtgaagatgngcaaacgctacagcgtggacaaatctctcagccacccctggttacaggagtaccagacgtggctggacctccgagaagctggtaggggaagatgggagagcgatacatcacgcatganagtnacgacgcgcgctnggagcagtttgcagcagagcatccgctgcctgggtctnggctncccacggncaggggtctcggtggggcctgtccaccacaggaccangacatncaggggntngcggaggcattcagtgttctctgaggtcctgtgccctngtccanntgctnnccttcacagggggtttttaanaggntcccagcatgt

SEQ ID NO: 296 - DNA, 205 bp; single-stranded, linear
  immediate source library: BRAINOT10
  immediate source clone: 1785924
cgcacccccggggcttcggctccggcacggtcgcgcccagctttcctgcacctgangccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcac

SEQ ID NO: 297 - DNA, 4078 bp; single-stranded, linear
  immediate source library: PLACNOB01
  immediate source clone: 179527
ccacgcgtccggttgccaacccgcaggcgactgggcgcttcatcccaccctcacccctttccagccaaggtggctgatcggagtcaggctctcgaggtcgcattgccacgaaacggngtgtgtgagcgcgttgtccccggnccccggggccacttcccctcggcctagnagactggactggggaaggacgggtctgttgtacccgggaggtggaaggaaaagccgaaagcggagaagtgtgcgggaggggagtctccgcgcggaggnagaccggnctcctccagtgcaggttgtgcgctggggagccagccasggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttggagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgtggtattgcagtggcagcaacagagcctatcggcatggaatatctcgaggtgctgaagctcctcttcttgatgactttgtcatgtcttacctctttgctcagtggcggcatgattttgtgcatggatggataaaagtacctgtgactcatgaaacacaggaagaatgtcttgggatgacagtgttagatatgatgagaatagccaaagaaaacgatcaaaccccactggccatctataactctatcagctacaagacattcttaccacaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacaggaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccttggggttttctggtgcctttgaagaccgggatcctacacagtttgaagagagacatttgaaatttctacagcaacttggcaagggtaattttgggagtgtgnagatgtgccggtatgaccctctacaggacaacactgggcaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggrgattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattggtgnggactattattacatatntcattattatataaatcatgatgctagccagcaaagatgtgaaaatatctgctcaaaactttccaaagtttagnaagtttntcttcatgagggcaccagtnaaagacattaatgagaattccntagcaaggattttgngagaagnttcttaaacattgtcagntaacatcactcttgtctggcaaangaaaaaaatagactttttcaactcagctttttgagacctggagaattattatgtaaattttgcaatgt

SEQ ID NO: 298 - DNA, 212 bp; single-stranded, linear
  immediate source library: PROSTUT05
  immediate source clone: 1796032
cgagaatctgcatttctgctcagatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctga

SEQ ID NO: 299 - DNA, 225 bp; single-stranded, linear
  immediate source library: COLNNOT27
  immediate source clone: 1801513
ccaaattcatactggggtaatttattcagattataaagggggaattcagttagtgatcagctccactgttccctggagtgccaatccaggtgatagaattgctcaattactgcttttgccttatgttaaaattggggaaaacaaaacggaaagaacaggagggtttggaagtaccaaccctgcaggaaaagccacttattgggctaatcaggtctcagaggatag

SEQ ID NO: 300 - DNA, 208 bp; single-stranded, linear
  immediate source library: COLNNOT27
  immediate source clone: 1802032
gtgagaacaccgatgggctggtgtatgttgtggacagtacagacaaacagcgactggaagagtctcagagacagtttgagcacattttgaagaatgaacacattaaaaatgngcctgntgttctattagccancaaacaagacatgcctggagctctgactgctgaggacatcaccngaatgttcaaagtgaagaagctttgcagtga

SEQ ID NO: 301 - DNA, 253 bp; single-stranded, linear
  immediate source library: COLNNOT27
  immediate source clone: 1802436
ggctacacccgcgtgtctgattacaaacaccactggagcgatgtccttgttggcctcctgcagggggcactggtggctgccctcactgtctgctacatctcagacttcttcaaagcccgacccccacagcactgtctganggaggaggagctggaacggaagcccagcctgtcactgacgttgaccctgggcgaggctgaccacaaccactatggatacccgnatcctcctcctgaggccggacccggccaag

SEQ ID NO: 302 - DNA, 221 bp; single-stranded, linear
  immediate source library: COLNNOT27
  immediate source clone: 1802489
aaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatccttt

SEQ ID NO: 303 - DNA, 274 bp; single-stranded, linear
  immediate source library: COLNNOT27
  immediate source clone: 1802982
gtggtctgatcttcctgcggctgaaccgcccggctgagccgacattgccggcgtcttggcgattcggcccgacganctccgctttcgntacagcatggtggcctactggagacaggctggactcagctacatccgatactcccagatctgtgcaaaagcagtgaganatgcactgaagacagaattcaaagcaaatgctgagaagacttctggcagcaacgtaaaaattgtgaaagtaaagaaggaataatctaccctgactaaagcttgaaat

SEQ ID NO: 304 - DNA, 248 bp; single-stranded, linear
  immediate source library: PROSTUT12
  immediate source clone: 1811958
ctttgccaccatggtgcggccggtggccgagagcggggccaccaagaccagccgcgtctacggcttcatcggcctctgctggctgctggccgcgctgctggggatgctgcctttgctgggctggaactgcctgtgcgcctttgaccgctgctccagccttctgcccctctactccaagcgctacatcctcttctgcctggtgatcttcgccggcgtcctggccaccatcatgggcctctatggggcca

SEQ ID NO: 305 - DNA, 244 bp; single-stranded, linear
  immediate source library: PROSTUT12
  immediate source clone: 1812162
ccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccganccggcgcangacctcttcgactttatcacggagcgcggcgccctggacgagccgc

SEQ ID NO: 306 - DNA, 245 bp; single-stranded, linear
  immediate source library: PROSTUT12
  immediate source clone: 1812894
ggaggaatcactgcccagctctgtgccagagctgcagcagctgctgtgctgcacgcggcaagaggcgagggcccggctgcaggcccaggagcacggggccgagcgcctgcngatcgagatcgtgacgctgcgggaggctctggaggaggagacagtggccagggccagcctggaggggcagctgagggtgcagcgggaggagacagaggtgctggaggcctccctgtgcagcctgaggacagaga

SEQ ID NO: 307 - DNA, 252 bp; single-stranded, linear
  immediate source library: PROSTUT12
  immediate source clone: 1813005
gcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccag

SEQ ID NO: 308 - DNA, 207 bp; single-stranded, linear
  immediate source library: PROSNOT20
  immediate source clone: 1814190
gcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagtggcgctctgggacccagaaaacctcgagga

SEQ ID NO: 309 - DNA, 270 bp; single-stranded, linear
  immediate source library: PROSNOT20
  immediate source clone: 1816626
tcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacag

SEQ ID NO: 310 - DNA, 263 bp; single-stranded, linear
  immediate source library: PROSNOT20
  immediate source clone: 1819167
attaggacccataccacaacacatgattcagaaaacaagaaaacgcaagtattttcaccataaccagctagattgggatgaacacagttctgctggtagatatgttaggagacgctgcaaaccgttgaaggaatttatgctttgtcatgatgaagaacatgagaaactgtttgacctggttcgaagaatgttagaatatgatccaactcaaagaattaccttggatgaagcattgcagcatcctttctttgacttattaaaaa

SEQ ID NO: 311 - DNA, 269 bp; single-stranded, linear
  immediate source library: PROSNOT20
  immediate source clone: 1819255
cgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattga

SEQ ID NO: 312 - DNA, 936 bp; single-stranded, linear
  immediate source library: CARDNOT01
  immediate source clone: 184111
nacgtccacgcgtccggtaatgactgtgggaagtcctcccgncagaagacaacactctctctacatcagagnaatccatacaggtgagaaaccctatatttgtaaagaatgtgggaagtcctttcaccagaaggaaaatcttactgtacatcagagaactcatacaggggaaangccctatatttgtaatgantgtgggaaatcctcctcccagaagacaacccttgntcttcatgagaaaactcataatgaggaganaccctntntttgnngtgantgtggaaagtccttccnccagaagacaacccttgtagcacatcagagaacacatacaggggaganttcttatgaatgtccncactgtgggaatgccttcagattgaagtcacgcctcattcgncatcagagtaactcacacgggagagcaaaccatatgagtgttatnactgtgggaagtccttccgccagatgaaaacacnctctctncatcagagaatccanacaggtnagccccccctttattggncaagantgtnggccgtccntccaccagaaaggctactcttcctncccatcagagancntcantncaggggacacccctcttttcgtatgcatttgggnnatccccnctccccgaanacannccntgtnctttcacncagaaaatttcantncgnngagnnccccnctctntngtcggtctantgttgggnangccccttcaanttttttntcccnccccccntatctnacnatcnccncatacntcttccactnattttgcctcatcgcnngnntctctctntncnccacccgnnntctccccttttcnacnctctnggcgnanttngctntccctnttnggtccacccncactttcttganttntcnactcncngtcccntcnnttcnactatcgtctccctcantccn

SEQ ID NO: 313 - DNA, 254 bp; single-stranded, linear
  immediate source library: COLNNOT08
  immediate source clone: 1843692
caccacagccatttccagcatgaagatcactgggggtctccttctgctctgtacagtggtctatttctgtagcagctcagaagctgctagtctgtctccaaaaaaagtggactgcagcatttacaagaagtatccagtggtggccatcccctgccccatcacatacctaccagtttgtggttctgactacatcacctatgggaatgaatgtcacttgtgtaccgagagcntgaaaagtaatggaagagttcagt

SEQ ID NO: 314 - DNA, 788 bp; single-stranded, linear
  immediate source library: CARDNOT01
  immediate source clone: 184712
gtgctgcgggatgccgtcccttcgcgcgtgaggctgcggttctgacgccccataggctccttcaatttccgtgatcctcggagtccccaggagaccaggtgatggaagnagccagactcctgccagtgccggnaggaccccaggccaagctgacctncgaggatgtggctgtgctccnctcccaggatgaatgggaccgcctgtgccctgntcagaggggnctctacagaaatgtgatgatggaaacctatgggaatgtagtctcattgggacttccaggatccaagcctgacataatctcccagctggggggaggggntttttttttntacccggacaggaagggggctaagaagagccagggcctgtggagtgactactcagacaacctcaantatgaccacactacagnctgtacacaacaagacagtttntctngtccatggggaatntgaaaccaagggagagagtcaaantacagactngagtcccnacgccattantttcagngnaaacagtgattctgggggaaaacaccctcgggggaggatngancaacaaaatactgnanacagnaangcttctgnctgantccaanttctgctgacaccgccaagancaggtcttnaccanagcatgtcactnactcccaccaggcagnggnctngtgggagagaggccctccanntntnntgnngtntnagaaagcnnctnggnccgnnagtnccacccccctccancancacntncnccacacngggagaggaagncccccattttttcnggnt

SEQ ID NO: 315 - DNA, 283 bp; single-stranded, linear
  immediate source library: LUNGFET03
  immediate source clone: 1849449
gtttcagagatctgaaaattgtcaatgctttgtccattgatgtggatatccaggtcagtcctgtttgggcttttagaaaccagaggagttggaaattcagggacagtcttgtcaaaattctccatcttgatttgatattcacctttggaacctcgggtcaacagagatgcaaaacagtgatgtaacatgatttcagacggtaggtaggatgtcctcctttggcatatttctccagtgccctcctgcattgctgaaaggaatacaactaattcaaagtgagaag

SEQ ID NO: 316 - DNA, 242 bp; single-stranded, linear
  immediate source library: LUNGFET03
  immediate source clone: 1850226
tttcagttcgaagcaactggtggcaaaaggttagcatttaagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagg

SEQ ID NO: 317 - DNA, 273 bp; single-stranded, linear
  immediate source library: LUNGFET03
  immediate source clone: 1850885
agacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacganggggaactgaaggaaattaagcaggacatctcaagtctccgctatgaactccttgaagaaaaatctcagaatacagaaga

SEQ ID NO: 318 - DNA, 261 bp; single-stranded, linear
  immediate source library: LUNGFET03
  immediate source clone: 1853144
gaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggag

SEQ ID NO: 319 - DNA, 288 bp; single-stranded, linear
  immediate source library: LUNGFET03
  immediate source clone: 1853379
gaaggaggtctaaagccaggtggggcaacagcggtggcagggcagggggtggtgggccagactggtccccgggggacttcttcacaggggctgctggcgagctctttctctttagggactgctccataccccatgatggagcacacggtgtagggaagccagaaagaaaagacggcccagccacagaagcacaatggcccttcgctctcccccagccccaccatgatgcccccatgcctgggcgtgggggaagatcatttgccaagaggcagctactgcaagtctttg

SEQ ID NO: 320 - DNA, 251 bp; single-stranded, linear
  immediate source library: HNT3AZT01
  immediate source clone: 1854243
gcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagcccccgggaaagagatc

SEQ ID NO: 321 - DNA, 277 bp; single-stranded, linear
  immediate source library: HNT3AZT01
  immediate source clone: 1854478
ggacatctctagacttcgcaggaagctggagacnacaaagaaaccagacaatgtacccaagtgtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcncaaatgtcccaagtgtaatgctgcttttggtgccaatgattttcatcgcatctacattggttga

SEQ ID NO: 322 - DNA, 266 bp; single-stranded, linear
  immediate source library: PROSNOT18
  immediate source clone: 1859317
ggccactcttcgttttccatgtactgcatgctgtttgtggcactttatcttcaagccaggatgaagggagactgggcaagantcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaaga

SEQ ID NO: 323 - DNA, 265 bp; single-stranded, linear
  immediate source library: SKINBIT01
  immediate source clone: 1870882
gaagacactggccgatgacctgcagacgtcctccaccgaggaggaggttccctgctgtggctacctgaacgtgctggtgaaccagggctggaaggaacgctggtgccgcctgaagtgcaacactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatt

SEQ ID NO: 324 - DNA, 269 bp; single-stranded, linear
  immediate source library: LEUKNOT02
  immediate source clone: 1872615
gttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcg

SEQ ID NO: 325 - DNA, 254 bp; single-stranded, linear
  immediate source library: LEUKNOT03
  immediate source clone: 1880501
cacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctgggga

SEQ ID NO: 326 - DNA, 700 bp; single-stranded, linear
  immediate source library: LEUKNOT03
  immediate source clone: 1881130
gaaagttgtctgcgtctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggasgtgngagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtca

SEQ ID NO: 327 - DNA, 263 bp; single-stranded, linear
  immediate source library: BLADTUT07
  immediate source clone: 1888801
cgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgatacatccgcagcgtgtgccgggtctgggg

SEQ ID NO: 328 - DNA, 135 bp; single-stranded, linear
  immediate source library: CARDNOT01
  immediate source clone: 189981
gttaaactctggtttagtagcttctttgtctttgtcaacacgatcgggcactagatggccatgagctgtcttcatcagaacctcaaagtcagaatcagcatcataatcttccaagtcattcttgggcccaaaaag

SEQ ID NO: 329 - DNA, 245 bp; single-stranded, linear
  immediate source library: CONNTUT01
  immediate source clone: 1907628
ttcgattcttggaaaaactacactgacgtagactgtgtctatatgaaaaatgtgtatggtggcacagatagtgataccttctccatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatgg

SEQ ID NO: 330 - DNA, 275 bp; single-stranded, linear
  immediate source library: CONNTUT01
  immediate source clone: 1909132
cgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcggtcatgtgtgtcctgctctgggccctgtccctgctgcggagtatcctggagtggatgttctgtgacttcctgtttagtggtgctgattctgtttggtgtgaaacgtcagatttcattacaatcgc

SEQ ID NO: 331 - DNA, 253 bp; single-stranded, linear
  immediate source library: CONNTUT01
  immediate source clone: 1911587
attcaccatcaccttggctctgtcattctgatcttttccacccagggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatcngctctactgatcttctccga

SEQ ID NO: 332 - DNA, 267 bp; single-stranded, linear
  immediate source library: PROSTUT04
  immediate source clone: 1913754
ctcccgagcgtctcgccccgctcacaggttccgcccttggcctctggtcccgccccactgccagcacctggagcagtttccgcagtcgatgatggcgttgtaggaggcgtttaccgagccgaagtagtactgggtctgtttcatgacgcagctgctctcgcgcgtctcggggctcccctcggcctccgcggggtctgcnagggcccagagcgcctcanctccgcccacagaccctggcaaggtctccggcctccctcagtcgtagac

SEQ ID NO: 333 - DNA, 278 bp; single-stranded, linear
  immediate source library: PROSTUT04
  immediate source clone: 1916151
agcaaggtaaatgggaagttggtagctctgaaggtgatcaggctgcnggnngaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtctta

SEQ ID NO: 334 - DNA, 258 bp; single-stranded, linear
  immediate source library: PROSNOT06
  immediate source clone: 1917286
caaactttcagcagttatttagatatttagtcctggatattgcagataatccagttgaaaatataatacgttttttccctatgactaaggaatttattgatgggagcttacaaatgggaggaaaagttcttgtgcatggaaatgcagggatctccagaagtgcagcctttgttattgcatacattatggaaacatttggaatgaagtacagagatgcttttgcttatgttcaagaaagaagattttgtattaatccta

SEQ ID NO: 335 - DNA, 279 bp; single-stranded, linear
  immediate source library: BRSTTUT01
  immediate source clone: 1920752
tccgcggccacgaatgtgnggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaa

SEQ ID NO: 336 - DNA, 249 bp; single-stranded, linear
  immediate source library: KIDNNOT02
  immediate source clone: 193629
cttcttgtgccgggccggatggnggaggtggaatgcccgagattcctccggatgctcaccagcagaaatggttcctttttccgaaactgcacacaggatgtgntggtcagaanccttccccaggcctaatctggcctntggngttaatngttncgtcttttccaacgngaagcggcncttctatcctnctgnagntgaaagtnatgtacaccgttgggctacagcgnctccctgggtcantgntcctgg

SEQ ID NO: 337 - DNA, 147 bp; single-stranded, linear
  immediate source library: KIDNNOT02
  immediate source clone: 194510
cttacaaatntaaggtttctgacaagacttgggagtgattcacacctggaacaacatactggacttcacactggagagaaaccttacaagtgtaatgagtgtggcaaagnctttggcaancagtcaacacttattcnccatcaggca

SEQ ID NO: 338 - DNA, 944 bp; single-stranded, linear
  immediate source library: KIDNNOT02
  immediate source clone: 195647
acgcgtccggaaacttaagtcttacatattttttgtgggctcactaagtgttctgctgtgtttcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatsgaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgycagggatgggcgtgttttgggcgtgctagaggtgtcacgctccattggggacgngcagtacaagcnctgcggtgtnacctctgtncccnacatcagacgctgccagctgacccccaatnacaggttcattttnttggcctgtnatgggctcttcaaggtctttacc

SEQ ID NO: 339 - DNA, 268 bp; single-stranded, linear
  immediate source library: BRSTNOT04
  immediate source clone: 1961860
ggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcct

SEQ ID NO: 340 - DNA, 253 bp; single-stranded, linear
  immediate source library: BRSTNOT04
  immediate source clone: 1963281
gcggacggccgtcgcccaagccaagccgcgctgccaaccctcccgcccgcccgcgctcctgtccgccgtgtctagcagcggggcccagcatggtcatggcggatggcccgaggcacttgcagcgcgggccggtccgggtggggttctacgacatcgagggcacgctgggcaagggcaacttcgctgtggtgaagctggggcggcaccggatcaccaagacggaggtggcaataaaaataatcgataagtctca

SEQ ID NO: 341 - DNA, 275 bp; single-stranded, linear
  immediate source library: BRSTNOT04
  immediate source clone: 1963772
ccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgaacgagtgattggtggcttagagaagaaaacgcaggttctgcagcctgaggagaagaagactgtggcataccacgaagcaggccatgcggttgccggct

SEQ ID NO: 342 - DNA, 219 bp; single-stranded, linear
  immediate source library: KIDNNOT02
  immediate source clone: 196640
tatcagtntcgttagtntggcaaagcttcattcagaatgcagggcttttcagcatctccgagtccacactggtgagaaaccctatcantgcagtcagtgcagtaaactctttagtaagcggacacttcttaagaaacatcagaaaatccacactggagagagaccataagggtgatgagtttggggaagccttcagtcatcattgcaaccttattaggg

SEQ ID NO: 343 - DNA, 297 bp; single-stranded, linear
  immediate source library: BRSTNOT04
  immediate source clone: 1966404
cgcaccacctggccaatgagatgatgatgtaccacatgaaggtctccgacgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgcct

SEQ ID NO: 344 - DNA, 245 bp; single-stranded, linear
  immediate source library: UCMCL5T01
  immediate source clone: 1971037
agctggtgctggcggccatcaccagccacatgcggtcgcgacgctgggtctactattgcctggtgaacatcacgctgagtgacctgctcacgggcgcggcctacctggccaacgtgctgctgtcgggggcccgcaccttccgtctggcgcccgcccagtggttcctacgggagggcctgctcttcaccgccctggccgcctccaccttcagcctgctcttcactgcaggggagcgctttgccacc

SEQ ID NO: 345 - DNA, 257 bp; single-stranded, linear
  immediate source library: UCMCL5T01
  immediate source clone: 1973931
aggttcctctccccactctggggtgtccagacaggtgcggatcaaggcttcccagtccgcagggatataaatactatctaccagccccccgagcccagaagcaggcacctctctgtcagctcccagaaccctggccgaagctcacctccccctggctatgttcntgagcggcagaagcacattgcccgggnggggtcntacaccagcatcaacagtgagggggnttcatcccagagaccagcgagnttttttanaaa

SEQ ID NO: 346 - DNA, 204 bp; single-stranded, linear
  immediate source library: KIDNNOT02
  immediate source clone: 197500
cagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtntgt

SEQ ID NO: 347 - DNA, 259 bp; single-stranded, linear
  immediate source library: CORPNOT02
  immediate source clone: 1989157
cccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaa

SEQ ID NO: 348 - DNA, 263 bp; single-stranded, linear
  immediate source library: CORPNOT02
  immediate source clone: 1989493
ctgtgactcttcttgtagcattaaaggtgcgttatccagaacgcattacaatattgagaggaaatcacgaaagccgacaaattacccaagtntatggcttttatgatgaatgtctgcgaaagtatgggaatgccaacgtttggaaatattttacagatctctttgattatcttccacttacagctttagtagatggacagatattctgcctccatggtggcctctctccatccatagacacactgggtcntataagagccctg

SEQ ID NO: 349 - DNA, 267 bp; single-stranded, linear
  immediate source library: CORPNOT02
  immediate source clone: 1989936
ccaagttttgtgactacgggaaggctcccggggcagaggagtacgctcaacaagatgtgttaaagaaatcttactccaagggctttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtg

SEQ ID NO: 350 - DNA, 230 bp; single-stranded, linear
  immediate source library: CORPNOT02
  immediate source clone: 1992818
aagatggtcttctaagtaatgtgtctcatgttattgtagatgaggttcatgaaagaagtgnccagtcagacttccnactaattatcttgaaggaaattttacagaaacgttctgatcnacacttgattctaatgagtgccactgtggacagcgaaaaattttctacatatttcacacactgccccattctcagnatttcaggaagaagttancctgttgaggtttttcac

SEQ ID NO: 351 - DNA, 300 bp; single-stranded, linear
  immediate source library: CORPNOT02
  immediate source clone: 1992915
gcagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcgnctacagcgacacagcctggatctcctccatcctgctggccatgctctacgggacaggtccgtc

SEQ ID NO: 352 - DNA, 222 bp; single-stranded, linear
  immediate source library: CORPNOT02
  immediate source clone: 1994216
cacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtga

SEQ ID NO: 353 - DNA, 261 bp; single-stranded, linear
  immediate source library: BRSTTUT03
  immediate source clone: 1996651
cctagatgggacaatcgcctatcaccgagtggtgagaccatcgcctatagctgagcggcgagacaatcacctatcgccaagcaaatgagcaaacagttgtcttcaccatcccagacaagcagatgaatggtgaaacgatacagcagagaaagagagaagaggaacatttgaacgccgagaggagttcagccgagggtggtcggagaggtttggccacccagcaggaagattatcttcccgtgccatccccgcttccagctc

SEQ ID NO: 354 - DNA, 305 bp; single-stranded, linear
  immediate source library: BRSTTUT03
  immediate source clone: 1998162
cttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgaggnggcgctgcaggacctcgcgcctgacactgcgctctagccccgcgcgccgtggcaccccaacaccggcagggaacctaccctcggctcccgggtctcccctccctcntcaccccaaccagcggcttctgcgccgccctccgccctccgctggctccgaggtggtg

SEQ ID NO: 355 - DNA, 196 bp; single-stranded, linear
  immediate source library: TESTNOT03
  immediate source clone: 2011686
gacatctggagcctaggcgtgatcctctacatcatggtctgcggctccatgcnctacgacgactccaacatcaagaagatgctgcgtatccagaaggagcaccgcgtcaacttcccacgctccaagcacctgacaggcgagtgcaaggacctcatctaccacatgctgcagcccgacgtcaaccggcggctccaca

SEQ ID NO: 356 - DNA, 246 bp; single-stranded, linear
  immediate source library: TESTNOT03
  immediate source clone: 2012970
gaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagatacatcttggatagaa

SEQ ID NO: 357 - DNA, 258 bp; single-stranded, linear
  immediate source library: THP1NOT01
  immediate source clone: 2017571
cggcaggccctggggagccaggcaccaaagccaagaaggggcgtcggagccgcactgtgttcaccgagctgcagctgatgggcctggagaaacgcttcgagaagcagaagtacctttccacgccggacagaatagatcttgctgagtccctgggcctgagccagttgcaggtgaagacgtggtaccagaatcggaggatgaagtggaagaaaatagtgctgcagggcggcggcctggagtctcccaccaagcccaagg

SEQ ID NO: 358 - DNA, 280 bp; single-stranded, linear
  immediate source library: THP1NOT01
  immediate source clone: 2018356
gcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtg

SEQ ID NO: 359 - DNA, 250 bp; single-stranded, linear
  immediate source library: THP1NOT01
  immediate source clone: 2018536
tctcagtactttaacatcgtcgctctgcaacttttctatctgagcgcntctatcaacccaatcctctacaacctcatttcaaagaagtacagagcggcggcctttaaactgctgctcgcaaggnagtccaggccgagaggttccacagaagcagggacactgcgggggaagttgcaggggacactggaggagacacggtgggctacaccgagacaagcgctaacgtgaagacgatgggataaccagcacg

SEQ ID NO: 360 - DNA, 282 bp; single-stranded, linear
  immediate source library: CONNNOT01
  immediate source clone: 2023607
tgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatganaagggatatggaccagctacacaagttcggtggcttcaagg

SEQ ID NO: 361 - DNA, 285 bp; single-stranded, linear
  immediate source library: KERANOT02
  immediate source clone: 2024210
tgagtgagctaactgacacaatgaaactgtcaggcatgtttctgctcctctctctggctcttttctgctttttaacaggtgtcttcagtcagggaggacaggttgactgtggtgagttccaggaccccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggt

SEQ ID NO: 362 - DNA, 223 bp; single-stranded, linear
  immediate source library: KERANOT02
  immediate source clone: 2028257
tccgagagaagcaccagatcatgcaccgagatgtgaagccctccaacatcctcgtgaactctagaggggagatcaagctgtgtgacttcggggtgaacgcagtannnggagaatngntcccantccanntnntcngaatncagnccaacatggctccggagcggttgcagggcacacattactcggtgcagtcggacatctggagcatgggcctgtccctggt

SEQ ID NO: 363 - DNA, 247 bp; single-stranded, linear
  immediate source library: KERANOT02
  immediate source clone: 2029134
agtacagctgagcaaaacagcctgaaaaggagatggtttttttcttcaccaatacattttgcagcatcttgggcccaatagaagatgagtaacacagatcaatgaatgccaggtgactgaggaagtagtacatgggggtgtggagccgcgagtctgctctgatcagcaggatcatgccaaggtttcccaccagggtgatgagataaatgacaaggaacaccacaaagagggggagctgcagctcagg

SEQ ID NO: 364 - DNA, 253 bp; single-stranded, linear
  immediate source library: HIPONON02
  immediate source clone: 2039628
cgcgtggnagcacccgacgctggagaacgtggagacggcgtgcattggctggttcaccctggagtacctgctgcgcctcttctcgtcacccaacaagctgcacttcgcgctgtccttcatgaacattgtggacgtgctggccatcctccccttctacgtgagcctcacgctcacgcacctgggtgcccgcatgatggagctgaccaacgtgcagcaggccgtgcaggcgctgcggatcatgcgcatcgggcat

SEQ ID NO: 365 - DNA, 260 bp; single-stranded, linear
  immediate source library: THP1T7T01
  immediate source clone: 2047048
gcctgaggaatgagggagtcagctccgtgctcctgggggcctccantgcggaccagctcatggagaacattggggcaatacaggtccttccgaaactgtcgtcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagag

SEQ ID NO: 366 - DNA, 262 bp; single-stranded, linear
  immediate source library: LIVRFET02
  immediate source clone: 2049369
cgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcantagccctgctcacctggacgctgcaaggggcagccaatgcgcttagcggggatgtctggaacattgataacaacttctgaggccctggggatcctcacatcccc

SEQ ID NO: 367 - DNA, 259 bp; single-stranded, linear
  immediate source library: BEPINOT01
  immediate source clone: 2054141
attcgggtacaggagcctagagctcgccgagtacagtgcaatcggtgcaacgaggtcttctgtttcaagtgtcgtcagatgtatcacgcacccacagactgtgccacaatccggaaatggctcacgaagttgcagacgactctgaaacagccaactacattagtgctcacactaaagactgtcccaagtgcaacatctgcattgagaagaatggaggctgcaatcacatgcaatgctccaaatgtaaacacgacttctg

SEQ ID NO: 368 - DNA, 247 bp; single-stranded, linear
  immediate source library: BEPINOT01
  immediate source clone: 2054814
cggcttccccgaaaaccttccccgcttctggatatgaaattcaagctgcttgctgagtcctattgccggctgctgggagccagnagagnnctgaggagtattcactcagtagcagctgacgcgtgggtccaccatgaactggagtatctttgagggactcctgagtggggtcaacaagtactccacagcctttgggcgcatctggctgtctctggtcttcatcttcngcgtgctggtgtacctggtg

SEQ ID NO: 369 - DNA, 186 bp; single-stranded, linear
  immediate source library: BEPINOT01
  immediate source clone: 2055179
tatatatacttatttacacctgtgtctatatatttgcccctgtgtattttgaatatttgtgtggacatgtttgcatagccttcccattactaagactattacctagtcataattattttttcaatgataatccttcataatttattatacnatttatcattcagaaagcaataattaaanaagttt

SEQ ID NO: 370 - DNA, 259 bp; single-stranded, linear
  immediate source library: BEPINOT01
  immediate source clone: 2055790
ccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttc

SEQ ID NO: 371 - DNA, 236 bp; single-stranded, linear
  immediate source library: BEPINOT01
  immediate source clone: 2056018
cctgcgggatggcatgtcccacctgatccagtcggccggcctgggcggcctgaagcacaacacggtgctcatggcctggcccgcatcctggaagcaggaggacaaccccttctcctggaagaactttgtagacaccgtccgcgacaccaccgccgcgcaccaggctctgctggtggccaagaacgtcgactcgtttccgcaaaaccaggagcgcttcggcgggggccacatcgacg

SEQ ID NO: 372 - DNA, 257 bp; single-stranded, linear
  immediate source library: OVARNOT03
  immediate source clone: 2059915
tcttcgtcgttggctaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccancccccgcccacgtggcagcaaggatatggcccgcaaggaa

SEQ ID NO: 373 - DNA, 332 bp; single-stranded, linear
  immediate source library: OVARNOT03
  immediate source clone: 2060327
cttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtnaccctgcgacccactctttggaccagcagcnggatgaataaagcttcctgtgttgtgtg

SEQ ID NO: 374 - DNA, 248 bp; single-stranded, linear
  immediate source library: OVARNOT03
  immediate source clone: 2060769
cggaatgaaatcggtgacagtgagccacttgactccagggacacctggctcatcaataaggaccagatccaggacctgagcgccaagctcaagccctacgagaagaaggactggcgccacgcgccgcgcttcgtgacgcccctcaagccacacacggtgctccgcggccaggactgcaccatgacctgcgccttccttgggaacccgcggcccacagtgaccctctacaagggcgacgtcaacatcac

SEQ ID NO: 375 - DNA, 249 bp; single-stranded, linear
  immediate source library: OVARNOT03
  immediate source clone: 2061942
gaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaac

SEQ ID NO: 376 - DNA, 269 bp; single-stranded, linear
  immediate source library: OVARNOT03
  immediate source clone: 2062218
gctttgacccctactctatgttcaccccagagcagatcatggggaaggatgtccggctcctacgcatcaagaaggagggatccttagacctggccctggaaggcggtgtggactcccccattgggaaggtggttgtttctgctgtgtatgagcggggagctgctgagcggcatggtggcattgtgaaaggggacgagatcatggcaatcaacggcaagattgtgacagactacaccctggctgaggctgacgctgccctgcagaaggcc

SEQ ID NO: 377 - DNA, 281 bp; single-stranded, linear
  immediate source library: ISLTNOT01
  immediate source clone: 2069502
caggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattctcctgggagctacagctattgaagacaagctacaggatggagttccagaaaccatttcaaaacttgcaaaagctgacattaagatctgggtgcttactgg

SEQ ID NO: 378 - DNA, 138 bp; single-stranded, linear
  immediate source library: ISLTNOT01
  immediate source clone: 2077640
gtcattcacaaggagaaatccggttgttgcaatcttacgtggatgctgatgctgatgaaaacttttacacttgtgcatggacctatgatagcaatacgagccatcctctgctggctgtagctggatctagaggcataa

SEQ ID NO: 379 - DNA, 215 bp; single-stranded, linear
  immediate source library: ISLTNOT01
  immediate source clone: 2079292
agacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggctt

SEQ ID NO: 380 - DNA, 264 bp; single-stranded, linear
  immediate source library: UTRSNOT08
  immediate source clone: 2080608
gatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacaca

SEQ ID NO: 381 - DNA, 253 bp; single-stranded, linear
  immediate source library: UTRSNOT08
  immediate source clone: 2081193
gcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagtcggcgaccatgccctccatgcagtgcaaacacaggtcacccaacggggggctgttccggcagagccc

SEQ ID NO: 382 - DNA, 255 bp; single-stranded, linear
  immediate source library: UTRSNOT08
  immediate source clone: 2081690
cgaataaccgctggcgggaggagctctcccacatgaagcgacttcccccagtgcttcccggccgcccctatgacctggcggcggcgaccgtggccacagacctggagagcggcgganggntgcggcttgcggcggtagcaacctggcgcccctacctcggagagagaccgaggagttcaacgatctcctggacctggatttattctctccaattcgctgacccatcctccggagtcagtggccgcnacgtgtcnt

SEQ ID NO: 383 - DNA, 221 bp; single-stranded, linear
  immediate source library: PANCNOT04
  immediate source clone: 2087413
gacctttgatgggaagcttaagtgtcggtactgcaactatgccagcaaaggaacagcccggcttattgaacacatcagnatccacacaggtgaaaaacctcatcgatgtcatctttgtccatttgcatctgcttatgagcgtcatctggaagcccatatgcgttctcatactggagaaaaaccatacaaatgtgaattatgttccttccgctgcagtgatc

SEQ ID NO: 384 - DNA, 265 bp; single-stranded, linear
  immediate source library: PANCNOT04
  immediate source clone: 2088215
gccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttggg

SEQ ID NO: 385 - DNA, 247 bp; single-stranded, linear
  immediate source library: BRAITUT02
  immediate source clone: 2096740
cttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagat

SEQ ID NO: 386 - DNA, 232 bp; single-stranded, linear
  immediate source library: BRAITUT02
  immediate source clone: 2098429
tctttgcacctaagtgcagcagctgcaagcgccccatcgtaggtgggacaagggtcaaagaacggagtgngtagggtgcaggcaagggagtgggatgtggtattgggtgaggttgagggccggaccatccccacatctgcatagctaacttccagcctccctccaggactcggtggaggcaagtatgtgtcctttgaagaccgacactggcaccacaactgcttctcctgcg

SEQ ID NO: 387 - DNA, 270 bp; single-stranded, linear
  immediate source library: BRAITUT02
  immediate source clone: 2102405
agagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttga

SEQ ID NO: 388 - DNA, 250 bp; single-stranded, linear
  immediate source library: BRAITUT02
  immediate source clone: 2102713
tctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgct

SEQ ID NO: 389 - DNA, 262 bp; single-stranded, linear
  immediate source library: BRAITUT03
  immediate source clone: 2106395
ctggaagggcaggtcttccgcaagctggcctcataccagagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactg

SEQ ID NO: 390 - DNA, 248 bp; single-stranded, linear
  immediate source library: BRAITUT03
  immediate source clone: 2108581
ctcggagctctgctaccgcctgggggcctgccagatggtcatgtgtggcacaggcatgcagaggagcaccctgagcgtgtccctggagcaggcggccatcttggcacggagccatgggttgctgcccaagtgcatcatgcaggccacggacatcatgcggaagcagggcccaagggtggagattctggccaaaaacctgcgagtcaaggaccagatgccccagggtgctccgcgcctctaccgcctct

SEQ ID NO: 391 - DNA, 288 bp; single-stranded, linear
  immediate source library: BRAITUT03
  immediate source clone: 2108752
agaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaaca

SEQ ID NO: 392 - DNA, 277 bp; single-stranded, linear
  immediate source library: BRAITUT03
  immediate source clone: 2109526
cctggatctgcctcatcttgcctttatctccaatttcactatgaccatcaacaataaagtctacattgcagaagtcaaagagaagcaccaggcaaagaaaatctatgaagaagcccatcagcagggaaagacagctgctcatgtaggcatcagggaccgggaatcagagaagttccgcatctccaccagcctggcagcaggcacagaggtgactttttccctggcctatgaggaactgcttcagcggcaccagggccagtaccagctggtggtgagc

SEQ ID NO: 393 - DNA, 288 bp; single-stranded, linear
  immediate source library: BRAITUT03
  immediate source clone: 2109849
ctgccaccaacgtcgtggtgttggctggcaccaaccgccctgacgtcctggacccggccctcatgcggcctggccggtttcatcgccagatttacactggtcccccttacattaaaggcaggtcctccatctttaaggtccacctgcgcccactgaagctggacaagagcctcaataaggacaccctggcgaggaagctggcagtgctcaccccaggcttccctggtgtccatcataccccagggcaaggggctccgttacgcacagtacctgccccgggagcagcag

SEQ ID NO: 394 - DNA, 211 bp; single-stranded, linear
  immediate source library: BRAITUT03
  immediate source clone: 2110163
ctgcggggnggggagctgctggagcacatccgcaagaagcggcacttcagcgagtcggaagcaagccagatcctgcgcanctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcg

SEQ ID NO: 395 - DNA, 257 bp; single-stranded, linear
  immediate source library: BRAITUT03
  immediate source clone: 2110277
tgcatcccccagggcatgaccctggattgtgtggagatttctctgggccgtgtgtttgccagtggccaggcctatgtggccctttctcggncccgcagcctgcagggcctacgtgtgctggactttgaccccatggcggttcgctgtgacccccgtgtgctgcacttctatgccaccctgcggcggggcaggagcctcagtctggagtccccagatgatgatgaggcagcctcagaccaggagaacatggacccaaa

SEQ ID NO: 396 - DNA, 242 bp; single-stranded, linear
  immediate source library: BRAITUT03
  immediate source clone: 2111542
caaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtg

SEQ ID NO: 397 - DNA, 257 bp; single-stranded, linear
  immediate source library: BRAITUT03
  immediate source clone: 2113436
cgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcac

SEQ ID NO: 398 - DNA, 198 bp; single-stranded, linear
  immediate source library: BRAITUT03
  immediate source clone: 2114703
agcgaaatggcgcctccggcccccggcccggcctccggcggctccggggaggtagacgagctgttcgacgtaaagaacgccttctacatcggcagctaccagcagtgcataaacgaggcgcacgggtgaagtgtcaagcccagagagagacgtggaganngagtcttcctgtataaagcgttacctggcgnaaaanga

SEQ ID NO: 399 - DNA, 266 bp; single-stranded, linear
  immediate source library: BRAITUT03
  immediate source clone: 2114943
ctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagaca

SEQ ID NO: 400 - DNA, 281 bp; single-stranded, linear
  immediate source library: BRSTTUT02
  immediate source clone: 2117559
gtgccataagttacaatccctttgtgcctctggctgctccaacatcacagatgccatcctgaatgctctaggtcagaactgcccacggcttagaatattggaagtgggcaagatgttctcaattaacagatgtgggctttaccactctagccaggaattgccatgaacttganaagatggacctggaagagtgtgttcagataacagatagcacattaatccaactttctatacactgtcctcgacttcaagtattgagtctgtctcactgtgagctgatc

SEQ ID NO: 401 - DNA, 273 bp; single-stranded, linear
  immediate source library: BRSTTUT02
  immediate source clone: 2118071
ctgagagcccagggcagcagctacacggagtcctggagatggagcgcttacactacatccaccacaacgagaccgtgtcccagcagattggggaggtctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcact

SEQ ID NO: 402 - DNA, 259 bp; single-stranded, linear
  immediate source library: BRSTNOT07
  immediate source clone: 2121021
ctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactccggaatcctactatganccc

SEQ ID NO: 403 - DNA, 241 bp; single-stranded, linear
  immediate source library: BRSTNOT07
  immediate source clone: 2121175
cagaggtttgcgttgcaaggccttgagcaaggcgccacctaccctgtctcccttgttgcctttaagggtggtcgccggagcagaaatgtatccaccaccctctccacagttggtgcccgtttcccacacccttcggactgcagtcaggttcagcagaacagcaatgccgccagtggtctgtacaccatctacctgcatggcgatgccagccggcccctgcaggtgtactgtgacatggaaa

SEQ ID NO: 404 - DNA, 278 bp; single-stranded, linear
  immediate source library: BRSTNOT07
  immediate source clone: 2121278
tatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaa

SEQ ID NO: 405 - DNA, 273 bp; single-stranded, linear
  immediate source library: BRSTNOT07
  immediate source clone: 2121285
aaagccctgggagacctcatcagtgcaagaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgacca

SEQ ID NO: 406 - DNA, 163 bp; single-stranded, linear
  immediate source library: BRSTNOT07
  immediate source clone: 2121593
tgactttgtcggcatcatctgtactcgtctctcaccaaagaagattattgagaagtgggtggactttgccaggtgaggcaagaatggctcagggggtgggcagacatctggggcagggaaggcttgggtctgagcccttgcccggggcatgatctgcggggag

SEQ ID NO: 407 - DNA, 269 bp; single-stranded, linear
  immediate source library: BRSTNOT07
  immediate source clone: 2122108
cagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcc

SEQ ID NO: 408 - DNA, 107 bp; single-stranded, linear
  immediate source library: BRSTNOT07
  immediate source clone: 2122627
tatgactcctttctttctcgtctaggttgttcctcaaagtcattcaagctgtactcgccgaaggagcccccgaacggcaacgcctttccccccttccatcccggcac

SEQ ID NO: 409 - DNA, 275 bp; single-stranded, linear
  immediate source library: BRSTNOT07
  immediate source clone: 2123679
gagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaa

SEQ ID NO: 410 - DNA, 291 bp; single-stranded, linear
  immediate source library: BRSTNOT07
  immediate source clone: 2124153
gcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagt

SEQ ID NO: 411 - DNA, 303 bp; single-stranded, linear
  immediate source library: BRSTNOT07
  immediate source clone: 2124608
agcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcangctggccaggtgcagatgagctcctcagatgtcctgtaccctcgggcagcaggcatgccg

SEQ ID NO: 412 - DNA, 275 bp; single-stranded, linear
  immediate source library: BRSTNOT07
  immediate source clone: 2125658
ggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtcccaagaagtccttcctcccatgaagtcactgtgggaaacaggctcatccgcctcttctccaatggcacggtc

SEQ ID NO: 413 - DNA, 244 bp; single-stranded, linear
  immediate source library: OVARNOT03
  immediate source clone: 2132279
gctggaggaggaaaaggcaggcagtggactctgccagtattatctgtccaagattgaagaactccagggtcaactgcaatataaattggatgggggaaagccacaaggaacagttctgaactccaggtgcatttgcagctgattttgaatgataagacccaanncctctggaggcggcaggtgcacgggaatgaactaaatgttaaagtgtgcctattacaggaggagctacagctgctgcagg

SEQ ID NO: 414 - DNA, 281 bp; single-stranded, linear
  immediate source library: OVARNOT03
  immediate source clone: 2132361
tagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcga

SEQ ID NO: 415 - DNA, 244 bp; single-stranded, linear
  immediate source library: ENDCNOT01
  immediate source clone: 2137141
ctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgca

SEQ ID NO: 416 - DNA, 284 bp; single-stranded, linear
  immediate source library: ENDCNOT01
  immediate source clone: 2137420
aagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccc

SEQ ID NO: 417 - DNA, 169 bp; single-stranded, linear
  immediate source library: ENDCNOT01
  immediate source clone: 2137838
atctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggag

SEQ ID NO: 418 - DNA, 222 bp; single-stranded, linear
  immediate source library: BRAINOT09
  immediate source clone: 2148792
cgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggc

SEQ ID NO: 419 - DNA, 1834 bp; single-stranded, linear
  immediate source library: STOMNOT01
  immediate source clone: 214915
gcccgttgggccgcgaacgcagccgccacgccggggccgccgagatcgggtgcccgggatgagcctcatccggaaaaagggcttctacaagcaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgttgctgaagcacatgcagcatgagaacgtcattgggctcctggatgtcttcaccccagcctcctccctgngnaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggatttggggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccagcctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggta

SEQ ID NO: 420 - DNA, 288 bp; single-stranded, linear
  immediate source library: BRAINOT09
  immediate source clone: 2150261
caacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcatggcctggcattcatcgtctac

SEQ ID NO: 421 - DNA, 279 bp; single-stranded, linear
  immediate source library: BRAINOT09
  immediate source clone: 2150668
ggaaagacagcattttgactaaaaacttgatacttaaaatacttgtttcatcaataatcattgtttgtgggactttgtttgtcttctggcgtgantacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttctnggatccatcatgggacaattactaggaat

SEQ ID NO: 422 - DNA, 282 bp; single-stranded, linear
  immediate source library: BRAINOT09
  immediate source clone: 2153874
gggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttaga

SEQ ID NO: 423 - DNA, 97 bp; single-stranded, linear
  immediate source library: BRAINOT09
  immediate source clone: 2155287
ctttacgactggccaaaaactacatctgggcactttctgaaattctgagaatcggcaagagaccagatctgctcacattcgtccaaaacttatggaa

SEQ ID NO: 424 - DNA, 266 bp; single-stranded, linear
  immediate source library: BRAINOT09
  immediate source clone: 2155484
gccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagag

SEQ ID NO: 425 - DNA, 918 bp; single-stranded, linear
  immediate source library: STOMNOT01
  immediate source clone: 215793
ttcgaccacgcgtccgncaaaactgacgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaaggacacagtgttgaagcagatggagtctgctcaggaaaaagacttcctcagaagaagcactttgacaaccgtgtagtcccaggcaaacagnggtgctcttggacacaaaccaagtttcgctccagaaaattgacaaccctgagtcccaggcaaacagtggcgctcttgacacaaaccaanttttggtccacaaaaattcctcctaggaaaacgattgcgcaaaacgtgactcacaaagtttaaaaagttttgaaacataattcacgtgttaaaattcaatcaagnaagangttgtnaaaaggnaaaaanggccaagggaanggnattgttgntgggaaaacctncanccgggngtacttaaacaagattacgtttntttagaattcaaaaaggggaggcaagtttggcnnttgnagtgaatttggnanaatttcccgaacccnagantattttcttntgattaggaaaatccannccggngagaggccttttttttcaaaaatttgnaaaagnttt

SEQ ID NO: 426 - DNA, 210 bp; single-stranded, linear
  immediate source library: STOMNOT01
  immediate source clone: 215814
atttcttctactgtcaaaacccacatttctcatacatatgaatgtaattttgtggattcattattcacacaaaaagagaaagcaaatattgggacagaacactacaaatgtaatgagcgtggcaaggcctttcatcaaggcttacattttactatacatcaaataatccatactaaagagacgcaatttaaatgtgatatatgtggcaag

SEQ ID NO: 427 - DNA, 264 bp; single-stranded, linear
  immediate source library: ENDCNOT03
  immediate source clone: 2169507
catcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaangcacgcatgggctcagcgggactcagagttcttgctttggcttctggtcctgaactggg

SEQ ID NO: 428 - DNA, 254 bp; single-stranded, linear
  immediate source library: ENDCNOT03
  immediate source clone: 2170402
attacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatgtgagtagatggcctctctaatgcatctgtagatgg

SEQ ID NO: 429 - DNA, 246 bp; single-stranded, linear
  immediate source library: ENDCNOT03
  immediate source clone: 2171432
caaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccattctgagactganttttttatagcntattctttaatatnaangnngnacgggc

SEQ ID NO: 430 - DNA, 206 bp; single-stranded, linear
  immediate source library: ENDCNOT03
  immediate source clone: 2171634
accttgttcaacatcagagaagccatgtagggaaaaaaactctttcacagtgacccatggtattcatgccaacattggtgctcatttgtcactgaactgaagccaccctggagcccttaatggttacagaaattgtggaccagggctttatttaccactatacatcatcgggtattagaaaatgtagtctggctgagacgatgant

SEQ ID NO: 431 - DNA, 202 bp; single-stranded, linear
  immediate source library: ENDCNOT03
  immediate source clone: 2171638
gtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacct

SEQ ID NO: 432 - DNA, 241 bp; single-stranded, linear
  immediate source library: ENDCNOT03
  immediate source clone: 2172576
atgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgttacatctccagagaaatcctgaggggactggcacatcttcacattcatcatgtgattnaccg

SEQ ID NO: 433 - DNA, 262 bp; single-stranded, linear
  immediate source library: ENDCNOT03
  immediate source clone: 2172609
gccagaccgaagtccccaacttttagttccatggcttcattaataaaaaagttccctagtttgagatctctgtgcaagatttcttgttcatgaaggtatttcagtccagacacaatctgcctgaggtagtatcgaacttctggctctgtcaacacctttcttgctttcaaaatatgagccattgaccttctactgcagtattccaagagaatgtaaatgttttctttgtcctcgaagtagtggtaaaactgcactacatgct

SEQ ID NO: 434 - DNA, 217 bp; single-stranded, linear
  immediate source library: ENDCNOT03
  immediate source clone: 2173757
ccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaa

SEQ ID NO: 435 - DNA, 229 bp; single-stranded, linear
  immediate source library: ENDCNOT03
  immediate source clone: 2174728
ctccaacccagatgcaggtgctcctggcccaggtccagaactcagagcagctgctgcggaccctgcaagggaccgtgagccaggcccaggagcgggtgcagctgcagatggtgagtacctgggggccctagggcaggagggcgaggagtccagcaggaatcagttgcacgtggtggaagggggcacgtgggaagtcaaggaacctgtcctgtccccagctgctcaggcc

SEQ ID NO: 436 - DNA, 247 bp; single-stranded, linear
  immediate source library: ENDCNOT03
  immediate source clone: 2175339
cacggctacgaatcagtggtttctgccagctgttagaggagatatccctccaggctgtgctgcccatggatttgtctgtgatggtaccagaatattagtatttgggggaatggttgaatatggaagatacagcaatgagttatatgagttacaagcaagtcgttggttatggaaaaaagtgaaaccccatccccctccttctggtttacctccttgtcctcggcttggacatagcttctctttatat

SEQ ID NO: 437 - DNA, 231 bp; single-stranded, linear
  immediate source library: ENDCNOT03
  immediate source clone: 2176878
ggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgcngggctcntgtgcatt

SEQ ID NO: 438 - DNA, 259 bp; single-stranded, linear
  immediate source library: SININOT01
  immediate source clone: 2181022
cgttacagaagctacgcatggatctgatccgtttacagcaccagacggaactggaaaaccagctggagtacaataagnggcganaaagagaactgcacagaaagcatgtcatggaacttcggcaanagccananaacttaaaggccatggaaatgcaaattannaaacagtttcaggacacttgcnaagtacagaccaaacagtatanagcactcangaatcaccagttggaagttactccaaagaatgagcacaaaac

SEQ ID NO: 439 - DNA, 263 bp; single-stranded, linear
  immediate source library: SININOT01
  immediate source clone: 2182105
gagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctgg

SEQ ID NO: 440 - DNA, 272 bp; single-stranded, linear
  immediate source library: PROSNOT26
  immediate source clone: 2185847
cgcgcttcctgctgactcagcacaggcgccaggaggccatggccgccctgcggttcctgtggggctctgagcagggctgggaagacccccccatcggggctgagcagagtttcacctggccctgctgcggcancccggcatctacaagcccttcatcatcggtgtctccctgatggccttccagcagctgtcgggggtcaacgccgtcatgttctatgcagagaccatctttgaagaggccaagttcaaggacagcagcctggcctcggtcg

SEQ ID NO: 441 - DNA, 278 bp; single-stranded, linear
  immediate source library: PROSNOT26
  immediate source clone: 2187310
acagacccctggggccttcctgcgcacctgcctgctgtcctcaaacagcaggagcctgctcaccggtggctacaacctggccagcgtgangtgtgggacctggcggcgccctccctgcatgtgaaggagcagttgccctgtgcaggtctcaactgccaggccctggacgccaacctggatgccaacctggccttcgccagcttcaccagtggtgtggtcaggatctgggacctgcgggatcagagtgtggtcagggacctcaagggttatcctgatgg

SEQ ID NO: 442 - DNA, 246 bp; single-stranded, linear
  immediate source library: THYRTUT03
  immediate source clone: 2190641
cttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagtgtcggagtgacctcccgnaaggcccagcccaagg

SEQ ID NO: 443 - DNA, 251 bp; single-stranded, linear
  immediate source library: THYRTUT03
  immediate source clone: 2191455
ggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaagg

SEQ ID NO: 444 - DNA, 238 bp; single-stranded, linear
  immediate source library: THYRTUT03
  immediate source clone: 2194081
gctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatcttttag

SEQ ID NO: 445 - DNA, 249 bp; single-stranded, linear
  immediate source library: THYRTUT03
  immediate source clone: 2194122
gcgtcgcggaggcacgtgtggagccccggcagcaggagcgtcgcaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggcaccggcagtggctctgtgtcccacgccatcatccgcaccat

SEQ ID NO: 446 - DNA, 171 bp; single-stranded, linear
  immediate source library: STOMNOT01
  immediate source clone: 219612
acgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaatgtaagc

SEQ ID NO: 447 - DNA, 241 bp; single-stranded, linear
  immediate source library: SPLNFET02
  immediate source clone: 2197276
aggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacanagggagcccagccctggngggctcagctaccttganggtgatggtcatcgacnccanngacaatcgccccacnatccccnaaggg

SEQ ID NO: 448 - DNA, 244 bp; single-stranded, linear
  immediate source library: SPLNFET02
  immediate source clone: 2198819
tcgggctccagaaatcctgatgggcagccgtcattacagcaatgctattgacatctggtctgtgggatgtatctttgcagaactactaggacgaagaatattgtttcaggcacagagtcccattcagcagttggatttgatcacggatctgttgggcacaccatcactggaagcaatgaggacagcttgtgaaggcgctaaggcacatatactcaggggtcctcataaacagccatctcttcct

SEQ ID NO: 449 - DNA, 259 bp; single-stranded, linear
  immediate source library: SPLNFET02
  immediate source clone: 2200254
gtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggc

SEQ ID NO: 450 - DNA, 275 bp; single-stranded, linear
  immediate source library: SPLNFET02
  immediate source clone: 2202505
atcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagaggtatgtattataaagcttgattgatcactgctttttcagatcaagggagatgtgtcaagttagaatccatcatgctttttagaataaaatccctaactctgccccacgcat

SEQ ID NO: 451 - DNA, 232 bp; single-stranded, linear
  immediate source library: STOMNOT01
  immediate source clone: 221058
cntcattcacgaaagaactcatgagagagagagactttaccccttctntgagtgtggggaagctgtgagtgacagcacccccttttttacaaaccatggagcccataaggcagagaagaagctctttgaatgtttgatttgtgggaaaagcttccggcagggcatgcacctcaccagacatcagagaacacacacaggagagaaaccgtataantntaccctttgtggggaa

SEQ ID NO: 452 - DNA, 249 bp; single-stranded, linear
  immediate source library: SINTFET03
  immediate source clone: 2211507
ctccagttggggtgcgcaagattgtcttggccaccaacattcctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaa

SEQ ID NO: 453 - DNA, 243 bp; single-stranded, linear
  immediate source library: SINTFET03
  immediate source clone: 2214140
ggcgcnatgagccgcagcctggactcggcgcgganttcctggagcggntggaagcncggggnggccgggagggggnagtnctcgcnggngagttcancganatccaggcctgctcggccgcctggaaggctgacggngtgtgctccaccgtggccggcagtcggccaganaacgtgaggaagaaccgctacaaagacgtgctgccttatgatcagacgcgagtaatcctctccctgctccagg

SEQ ID NO: 454 - DNA, 244 bp; single-stranded, linear
  immediate source library: LUNGNOT18
  immediate source clone: 2219040
aactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatg

SEQ ID NO: 455 - DNA, 262 bp; single-stranded, linear
  immediate source library: SEMVNOT01
  immediate source clone: 2224854
ctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacgg

SEQ ID NO: 456 - DNA, 1434 bp; single-stranded, linear
  immediate source library: PANCNOT01
  immediate source clone: 222689
aattcggcacgagaatcagaagtcagtttgggagaagtcaaaatggacacaatcttcktgtggagtcttctattgctgttttggggaagtcaagcctcaagatgctcagctcaaaaaaataccgaatttggaggggatctttatcaagaggtttccttrtctcataaggacaacattattttcaccccttggaataactttggttctygagatggtacaactgggagccaaaggaaaagcacagcagcagataagacaaactttaaaacaacaggaaacctcagctggggaagaatttcttgtcctgaagtcatttctctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagggatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcttctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataacccaacagaatcaattctgtttatgggaagagtgacaaatcctgacacccaggagataaaaggaagagatttagattcactgtgaatgaaaagcacagcctcagaataaaagatgatttctcaaaatagctgattgccaaaatatcgtcatcttgacaatatttactctatatcttatgtcttttctgttttaaactgtgcctgtagtaatagatatctgtcttgatgaataagtaaaattaggtatgcatttgtttccca

SEQ ID NO: 457 - DNA, 234 bp; single-stranded, linear
  immediate source library: SEMVNOT01
  immediate source clone: 2228229
gtggcattcagggatgtggctgngtactncacccaggaggagtggaggttgttganccctgctcagaggaccctgcacagggaggtgatgctggagacntataaccatctggtctcactggaaattccatcntctaaaccaaaacncattgctcagctggagcnaggggaagcgccctggagagaggagagaaaatgtccactggacctctgtccagacacagantgaagacat

SEQ ID NO: 458 - DNA, 249 bp; single-stranded, linear
  immediate source library: PROSNOT16
  immediate source clone: 2228712
cagttcagagcagaagtggatggcggtgaaatgcagtctgaagactgaggatcaggaagacatttacttcatgaaaggggccttggaagaggtgatccgctactgcaccatgtacaacaacgggggnatccccctgccgctgacgccccagcagaggtcattctgcctgcaggaagagaagaggatggggtcgctcggtttgcgggngctggccctggcttctgggcccgagctggggcggctgacgtt

SEQ ID NO: 459 - DNA, 259 bp; single-stranded, linear
  immediate source library: PROSNOT16
  immediate source clone: 2229049
ggaaaagacaatcagcatcaaggttcttacagtnagggggctcagatgaatggcattcagccagaagaaattggtagattgcgagaagagatagaagaattaaaacgtaatcaggaacttttacaaagcccagctgactgaaaaggactctatgattganaatatgaaatcttcccaaacatctggcacaaatgaacagtcttcagcaatagtttcagctagagattctgaacaagttgcagaattanacaggaacngg

SEQ ID NO: 460 - DNA, 237 bp; single-stranded, linear
  immediate source library: PROSNOT16
  immediate source clone: 2230457
agaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcc

SEQ ID NO: 461 - DNA, 255 bp; single-stranded, linear
  immediate source library: PROSNOT16
  immediate source clone: 2231705
gccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgntatgtcatgcgtcagagccgcccccactgctgcgcctgctacgaggccc

SEQ ID NO: 462 - DNA, 254 bp; single-stranded, linear
  immediate source library: PROSNOT16
  immediate source clone: 2231958
tgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaac

SEQ ID NO: 463 - DNA, 239 bp; single-stranded, linear
  immediate source library: PROSNOT16
  immediate source clone: 2232535
gtactgcccatggaaaaggagatcgaggagctgaaggcgaantgctgagggccgaggagctgattcaggagatccagagacgtccccggcatgccccttccctgcacggctccacggagttgctgcccctgtcccgggatccatcgcccccgctggagcctctggaggagtgagcggagatgggggtccagccgctgaggcnttcgctcacaactgcgatgacagcgcctccatctcct

SEQ ID NO: 464 - DNA, 254 bp; single-stranded, linear
  immediate source library: PROSNOT16
  immediate source clone: 2233388
gaagccggaccagtccaacgtcaggcggatgcacacggctgtgaagctcaatggcgtcgtcctcaacaagtcccaggatgcgcantgngtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcact

SEQ ID NO: 465 - DNA, 253 bp; single-stranded, linear
  immediate source library: PANCTUT02
  immediate source clone: 2234456
caaactctggtgttttctcaatcgaggcaaattctaaacatcattgaacgcctcttaaagaataggcactttaagacattgcgaatcgatgggacagttactcatcttttggaacgagaaaaaagaattaacttattccagcaaaataaagattactctgtttttctgcttaccactcaagtaggtggtgtcggtttaacattaactgcagcaactagagtggtcatttttgaccctagctggaatcctgcaa

SEQ ID NO: 466 - DNA, 251 bp; single-stranded, linear
  immediate source library: PANCTUT02
  immediate source clone: 2235851
ctgaaagactgcatcatcgtcggtggcatggacatggtggcccaggcgctggagctctctcggaaaccacacgtggtcatcgccacgccggggcgcctggcagatcacctgcgcantccaacacttttagtataaagaagatccgcttcctggtgatggatgaggcagaccggctgctggaacagggctgcactgacttcaccgtggacctggaggccatcctggcggctgtgncggcccgcaggcagaca

SEQ ID NO: 467 - DNA, 257 bp; single-stranded, linear
  immediate source library: PANCTUT02
  immediate source clone: 2237527
ggaggaggacttatcttctcccccagggctgcctgancccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacc

SEQ ID NO: 468 - DNA, 243 bp; single-stranded, linear
  immediate source library: PANCTUT02
  immediate source clone: 2239527
tgaccagctgctggaaaaagtgacagtgcagatggagccatcagnttcctatgaagtgctgtcttgtatcccagcccccagccttccttataaccaaccaggaatatgttacactcttgttcgtttgcctgatggatgaccctacagcagttgcaggctcctttagctgcaccatgaagttacagtccgggactgtgaccctaacactggagttccagatgaggatgggtatgatgatgagta

SEQ ID NO: 469 - DNA, 294 bp; single-stranded, linear
  immediate source library: PANCTUT02
  immediate source clone: 2240356
gaagctcctgcttgccactgggctggatggcagctatttgctgagggacagcgagaggtgccaggcgtgtactgcctatgtgtgcngtatcacggttacattnatacanaccgagtgtcccagacagaaacaggttcttggagtgctgagacagcacctggggtacanaaaaganattnccggaaaanaaaaaatctcatnncagcattncagaagccagancaaggcattgtaatacctctgcagtatccagttgagaagaagtcctcagctagaagtacacaaggtacnaca

SEQ ID NO: 470 - DNA, 102 bp; single-stranded, linear
  immediate source library: PANCTUT02
  immediate source clone: 2240520
gagcatgggcctgtccagcttcatctcgcggcgccacctgcagctcagcttccaggagccgcacttctacctgcgctgcctcggcaagaacggcgtcttcgt

SEQ ID NO: 471 - DNA, 263 bp; single-stranded, linear
  immediate source library: PANCTUT02
  immediate source clone: 2240612
tcagacgttttacaaattcatgaagcgaattgctgcttgtcaggagcagattttgaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggc

SEQ ID NO: 472 - DNA, 263 bp; single-stranded, linear
  immediate source library: PANCTUT02
  immediate source clone: 2243209
cactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtga

SEQ ID NO: 473 - DNA, 257 bp; single-stranded, linear
  immediate source library: PANCTUT02
  immediate source clone: 2243494
cagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctnaggatgaatgcgcactcgatttggac

SEQ ID NO: 474 - DNA, 229 bp; single-stranded, linear
  immediate source library: OVARTUT01
  immediate source clone: 2252446
gaagatctgattaaagaattaataaaaacaggtaacgatgccaagtctgtaagcaagcagtatactttgaaagtaacaaagctagagcatgatgcagaacaggcaaaagtcgaactaactgaaacacaaaagcagctacaggagctggaaaacaaagatctttctgatgttgcaatgaaggtaaaattacagaaagagtttcgtaaaaaggtggatgctgcaaagctga

SEQ ID NO: 475 - DNA, 231 bp; single-stranded, linear
  immediate source library: OVARTUT01
  immediate source clone: 2254533
ggggcgatggcatccgtggcctatccctgaacgccgcccgctacgccctgctgcgcgtggagcacggtcccccccacaccaagaactggaggccccaggtgctggtgatgctgaacctggacgcggaacaggccgtgaagcacccccgcctgctgtccttcacgncgcagctgaaggccggcaaaggcttgaccatcgtgggctcggtggttggangggacgtactggaca

SEQ ID NO: 476 - DNA, 240 bp; single-stranded, linear
  immediate source library: OVARTUT01
  immediate source clone: 2257828
gccttccagctgtaccaagaggctgctcagctggacatgctgctaganaagctgccccaggtggcagaggagatcagtggtcccttgacttcagccaataagatcacactggtgtccagcggcagtgggaccatgggggcagccaaagtgactggggaagtactggacattctaactcgcctgccaganantgtggaaagactcacaggcgtgagcatctcccaggtgaatcacaagcct

SEQ ID NO: 477 - DNA, 247 bp; single-stranded, linear
  immediate source library: OVARTUT01
  immediate source clone: 2258413
gtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggtgagagtacaaaa

SEQ ID NO: 478 - DNA, 242 bp; single-stranded, linear
  immediate source library: OVARTUT01
  immediate source clone: 2258521
cccgcccgctagcacgcagtcccttggtctcttcggtctcctgccgcccccgggaagcgcgctgcgtgccgaggcgagctaagcgcccgctcgccatggggagccccgcacatcggcccgcnnnnnnnnnnnnnnnnnnnnnnnnnnnnnnnnnnnnnnnnnnnngcgtcccgcccagccgcagcttcccaggatcgggagactcaccactagaagacgatgaagtcgggtattcacaccct

SEQ ID NO: 479 - DNA, 238 bp; single-stranded, linear
  immediate source library: OVARTUT01
  immediate source clone: 2258794
gtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgtacggcctgcccg

SEQ ID NO: 480 - DNA, 257 bp; single-stranded, linear
  immediate source library: OVARTUT01
  immediate source clone: 2259652
tcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactca

SEQ ID NO: 481 - DNA, 264 bp; single-stranded, linear
  immediate source library: UTRSNOT02
  immediate source clone: 2260261
cagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctgggccacccgtattcta

SEQ ID NO: 482 - DNA, 253 bp; single-stranded, linear
  immediate source library: UTRSNOT02
  immediate source clone: 2260639
cgctgctcggtgcccgagggcccctttccagggcatctggtggacgtgagcggcaccgggaccctttcccagagctaccagtacgaggtgtgtctgacgggaggctctgaaagtaatgatttcaagttcttgaagcctatattcccaaatattgtaagccaggactctaggaggaaatcagaatttctagaataatgtaggtatctgtagctttccgaccgtctgttaattttgtcttcctcacttttcacct

SEQ ID NO: 483 - DNA, 182 bp; single-stranded, linear
  immediate source library: UTRSNOT02
  immediate source clone: 2260826
aagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactat

SEQ ID NO: 484 - DNA, 236 bp; single-stranded, linear
  immediate source library: UTRSNOT02
  immediate source clone: 2261160
cacctttgaagatgaaaccagggcgcccacgaataaaaaaagatgagaagcagaacttactatccgttggcgattaccgacaccgtagaacagagcaagaggnggatgaagagctattaacagaaagctccaaagcaaccaatgtttgcactcgatttgaagactctccatcgtatgtaaaatggggtaaactgagagattatcaggtccgaggattaaactggctcatttctttg

SEQ ID NO: 485 - DNA, 823 bp; single-stranded, linear
  immediate source library: PANCNOT01
  immediate source clone: 226152
ctggcctcttactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggactgagcggtcacagacccctaaagggccatagcccagtgagcagcctggagccctggagaccccaccagcctcaccagcgcttgaagcctgaacccaagatgcaagaaggaggctatgctcaggggccctggagcagccaccccatgctggccttgccacactctttctcctgctttaaccaccccatctgcattcccagctctaccctgcatggctgagctgcccacagcaggccaggtccagagagaccgaggagggagagtctcccagggagcatgagaggaggcagcaggactgtccccttgaaggagaatcatcaggaccctggacctgatacggctccccagtacaccccacctcttccttgtaaatatgatttatacctaactgaataaaaagctgttctgtcttcccaccca

SEQ ID NO: 486 - DNA, 264 bp; single-stranded, linear
  immediate source library: UTRSNOT02
  immediate source clone: 2262662
ctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggt

SEQ ID NO: 487 - DNA, 252 bp; single-stranded, linear
  immediate source library: UTRSNOT02
  immediate source clone: 2263527
cagcactgtggccactgccagcactggggtggcagcctgccacatcgggggcaccaccctccatgcctttgcagagctgtccggcagcagaacaagccattcggagggatccagctcatcatctgtggggactttctgcagctgccacctgtgaccaagggctcccagcccccacggttctgcttccagtccaagagctggaagaggtgtgtgccagtgaccctggagctgaccaaggtgtggaggcaggca

SEQ ID NO: 488 - DNA, 226 bp; single-stranded, linear
  immediate source library: UTRSNOT02
  immediate source clone: 2263965
ccacaatgcctggaaccaggccgagctgtcccggctaaagagggagcaccctgagtcagaggacaggacgatcatcatggaggacaggctactgggcgtcctcatcccctgcagggcctttggggatgttcagctgaagtggagtaaagagttgcagcgcanattctggagaggggcttcaataccgaggccctcaacatttaccagttcacacccccacactact

SEQ ID NO: 489 - DNA, 283 bp; single-stranded, linear
  immediate source library: UTRSNOT02
  immediate source clone: 2269765
catctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactcc

SEQ ID NO: 490 - DNA, 272 bp; single-stranded, linear
  immediate source library: PROSNON01
  immediate source clone: 2271162
ccttgcccgaccaccagacgctcagccacaggctgccctgggttgagggcaaccgtgaggacggctacctctggggcctggacaacatgatctgcctcctgcaggggctggcacagagctgagctgctcagccaccatcaggttaattggatggcgccagtctggctggaggagccctgagatgccatgggaggcctgaggttggccacgggggagctggcctccagggacgggagagattgtgtcatgtgccacacgagaccaacgtggaa

SEQ ID NO: 491 - DNA, 277 bp; single-stranded, linear
  immediate source library: PROSNON01
  immediate source clone: 2271275
cctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgt

SEQ ID NO: 492 - DNA, 283 bp; single-stranded, linear
  immediate source library: PROSNON01
  immediate source clone: 2272231
cgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaantgtggccataataactgcttttctcatgaagactgaccaacttccctttgaaaaagcctatgaaaagctccagattctcaaaccagaggctaagatgaatgaggggtttgagtggcaactgaaattataccaggcaatgggatatg

SEQ ID NO: 493 - DNA, 279 bp; single-stranded, linear
  immediate source library: PROSNON01
  immediate source clone: 2272243
gcgtaagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaatt

SEQ ID NO: 494 - DNA, 282 bp; single-stranded, linear
  immediate source library: PROSNON01
  immediate source clone: 2272559
aagaaaacatcaacgaaaattcctgcaagcnattcatcaattaagaagtgtaaaaatggagcagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggc

SEQ ID NO: 495 - DNA, 272 bp; single-stranded, linear
  immediate source library: PROSNON01
  immediate source clone: 2272739
tgttaaatgaaantcntcccagactaaatcagtcacangagatcntgaggntgttttttantggccggtacatcctcctgctgatggggctgttctcngtgtacactggcctcatctacaacgactgcttttcnaagtcagtcancctgttcggctctgggtggaacgtgtcggccatgtacagctccagccacccacccgcagagcataagaagatggtgctttggaacgacagcgtcgttagacacaacagcnttttgcagctggatcca

SEQ ID NO: 496 - DNA, 284 bp; single-stranded, linear
  immediate source library: PROSNON01
  immediate source clone: 2274281
aaaaataatttatggtaatgttgtcagatactactgagaaatctatcctaatactcaaactttaaaattttcttcccatgcactagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaancttccagaatatntttccancatcagccannt

SEQ ID NO: 497 - DNA, 199 bp; single-stranded, linear
  immediate source library: PROSNON01
  immediate source clone: 2276067
tgtggactccaatgggggcattgaactgcccattgccctcgccatgggagccaaacttgaagaggaactctccatcggcactgtacaccttcactgaatggttatggaagtccgttactacaatttcattcttgttgttcacagccacaaaatggggccctgcaaagtggcggtcagtggccccacggcccccaaaang

SEQ ID NO: 498 - DNA, 256 bp; single-stranded, linear
  immediate source library: PROSNON01
  immediate source clone: 2276968
tgctcctggaacatcaagtgttcctgctccaactgcaggaaatgctgagaaattagaaattgctaagagattggctcttagaatcaatgcccagaagaatttgggcatcgagtctcaggatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaa

SEQ ID NO: 499 - DNA, 282 bp; single-stranded, linear
  immediate source library: PROSNON01
  immediate source clone: 2277516
cctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcntggcatggacaaagagcgctatgtctcccnggggatncgnggggcnntgnganacgtgaatggncnnttncncaa

SEQ ID NO: 500 - DNA, 278 bp; single-stranded, linear
  immediate source library: PROSNON01
  immediate source clone: 2278671
cacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaagggga

SEQ ID NO: 501 - DNA, 262 bp; single-stranded, linear
  immediate source library: PROSNON01
  immediate source clone: 2278736
cagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctg

SEQ ID NO: 502 - DNA, 280 bp; single-stranded, linear
  immediate source library: PROSNON01
  immediate source clone: 2278826
gaattcggtaagtattagacctggtatttttcttttttggtattttatctttagttttaatgttgtagtaaatgtttaccttttattttctctttttatagcggctatgtgactacgtttgtgacctcctcttagaagagtcaaatgttcagccagtatcaacaccagtaacagtgtgtggagatatccatggacaggtaaaatttcatgagcagatttttaagttttgtactgtccatgatccatgtgtgttttcacatgtgctgcaaaattaaaacaa

SEQ ID NO: 503 - DNA, 514 bp; single-stranded, linear
  immediate source library: PROSNON01
  immediate source clone: 2278920
gtcactgcaaggngccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgncaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgt

SEQ ID NO: 504 - DNA, 274 bp; single-stranded, linear
  immediate source library: PROSNON01
  immediate source clone: 2279267
ggaaagccttctgcacctgcttctcccacctctgtgtgattggactcttttatggcacagccattatcatgtatgttggacccagatatgggaaccccaaggagcagaagaaatatctcctgctgtttcacagcctctttaatcccatgctcaatccccttatctgtagtcttaggaactcagaagtgaagaatactttgaagagagtgctgggagtagaaagggctttatgaaaaggattatggcattgtgactgacagtgacctaggaagtt

SEQ ID NO: 505 - DNA, 263 bp; single-stranded, linear
  immediate source library: PROSNON01
  immediate source clone: 2279903
gtcccacttcgaagtggaggtctgccagctgccccggccaggcttgcggggagttctcttccgccgtgtggcgggcaccgcctgggccttccgcaccctcgtcacccgcatctccaacgacctcgagctctgagccaccacggtcccagggcccttantcttcctctcccttgtcgccttcanttctacaggaggggaagggnccagggatgggattctcnctttatcatnacctcagtttccctgaattatatttgggggaa

SEQ ID NO: 506 - DNA, 224 bp; single-stranded, linear
  immediate source library: BRAINON01
  immediate source clone: 2284088
gttttagtcaaagctcagacctcactaaacatcagagagtacactctggtgaaaagccttatcattgcaatagttgtgagaaagccttcagtcagagttctgaccttattcttcatcaganaattcacactggaganaaactattatctgtgcacacagtgcagcaaaagtttcagtcagatctcagacctcattaaacaccagagaatccacactgggganaa

SEQ ID NO: 507 - DNA, 261 bp; single-stranded, linear
  immediate source library: BRAINON01
  immediate source clone: 2285674
catgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttctcccggaaggactatcagcgcatgctggatctgatgcgggacatcatcttggccacagacctggcccaccatctccgcatcttcaaggacctccagaag

SEQ ID NO: 508 - DNA, 256 bp; single-stranded, linear
  immediate source library: BRAINON01
  immediate source clone: 2287624
cccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacac

SEQ ID NO: 509 - DNA, 277 bp; single-stranded, linear
  immediate source library: BRAINON01
  immediate source clone: 2287955
caaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcga

SEQ ID NO: 510 - DNA, 250 bp; single-stranded, linear
  immediate source library: BRAINON01
  immediate source clone: 2288091
gccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgat

SEQ ID NO: 511 - DNA, 222 bp; single-stranded, linear
  immediate source library: BRAINON01
  immediate source clone: 2289257
tttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagag

SEQ ID NO: 512 - DNA, 230 bp; single-stranded, linear
  immediate source library: BRAINON01
  immediate source clone: 2289873
ttattgctgtatgctttgtttatggcatagataagtttatggaagacctaaaagatatgctgggctttgctcccagcagatattactactatanctggaaatatatttctcctctaatgctattatcattgctaatagctagtgttgtgaatatgggattaagtcctcctggctataacgcatggattgangataaggcatctgaagaatttctgagctatccaacatgg

SEQ ID NO: 513 - DNA, 258 bp; single-stranded, linear
  immediate source library: BRAINON01
  immediate source clone: 2290031
gcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcg

SEQ ID NO: 514 - DNA, 225 bp; single-stranded, linear
  immediate source library: BRAINON01
  immediate source clone: 2290347
gcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaag

SEQ ID NO: 515 - DNA, 204 bp; single-stranded, linear
  immediate source library: BRAINON01
  immediate source clone: 2291504
gataattcatactggagaaaacgcctacatgtgtgaacaatatggcaaaacttaatgctcacactttattgctaggaaagcatttatacttgagataaattatacaaatataaagactgtgaaaaagccatcattatctgctcacattttactcaacaccagagagttcctgcttaataaaagcattataagtgcaaaanaaaa

SEQ ID NO: 516 - DNA, 260 bp; single-stranded, linear
  immediate source library: BRAINON01
  immediate source clone: 2291661
ctgaaggagactttcttcaacatcagaaaatttatattggagagaaatcctacaaatgtaataaatgtggaaaaacatttgttcaaaaactgcagcttaaacagtttacactagaaaatattttgtagatgcagtaaatgtgaagaaatatttagtctaaaaagaagagtatgtaaacatcagaggatttacagtagaaagaactaaggaactaacactttagacactgcagtaaatcagagtattaagtattaaaaaaa

SEQ ID NO: 517 - DNA, 230 bp; single-stranded, linear
  immediate source library: BRAINON01
  immediate source clone: 2292150
agatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgaganaattcagaaattcaccaaggacgtgagccatgaaatcatacaacatgaggttaaaagttcaaaaaactctgcatctagtgaaa

SEQ ID NO: 518 - DNA, 238 bp; single-stranded, linear
  immediate source library: BRAINON01
  immediate source clone: 2292418
tgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataa

SEQ ID NO: 519 - DNA, 221 bp; single-stranded, linear
  immediate source library: BRSTNOT05
  immediate source clone: 2294975
gccgctggagancnccgagccgctggggcccgcngccgatctgtgggccgacgtggacctcaccgagttcgaccagtacctcaactgcagccggactcggcccgangcccccgggctcccgtaccacgtggcactggccaaactgggcccgcncgccatgtcctgcccagaggagagcagcctgatctccgcgctgtcggacgccagcagcgcggtctatt

SEQ ID NO: 520 - DNA, 246 bp; single-stranded, linear
  immediate source library: BRSTNOT05
  immediate source clone: 2295842
gcccaaagcatgtgctgtcagagaggtctgtgctgcaggtggcctgccggctgctggatgccctggagttcctccatgagaatgagtatgttcatggaaatgtganagctgaaaatatctttgtggatccagaggaccagagtcaggtgactttggcaggctatggcttcgccttccgctattgcccaagtggcaaacacgtggcctacgtggaaggcagcaggagccctcacgagggggaccttg

SEQ ID NO: 521 - DNA, 203 bp; single-stranded, linear
  immediate source library: BRSTNOT05
  immediate source clone: 2297284
ttccagggtgttgtttgttgcttgtgtttgatttcagatttgagggataccctgagttaaacatgtgcctccttcccacaggcgtgtgtacatttcttatctggatagtattcatttcttccggccacgttgcctccgcacagccgtttaccatgagatccttattggatatttagagtatgtgaagaaattagggtgagttt

SEQ ID NO: 522 - DNA, 250 bp; single-stranded, linear
  immediate source library: BRSTNOT05
  immediate source clone: 2298442
gtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtga

SEQ ID NO: 523 - DNA, 258 bp; single-stranded, linear
  immediate source library: BRSTNOT05
  immediate source clone: 2298780
catcagcgagtcctggatctggtctcactcacaagccatggacaacatgagctcagtttgccaggactcttggggttagggagagctcagcatccgggtggctctggttccttctcatgctgaaactctgctggtgttcctccatggggcaaatgtgggtttttctgaggtgcccctcttgctggagttgaggatgagaaatgttttcagtgggtttgcaccctccacacatatgtaagaagtgttgtgtttcattcc

SEQ ID NO: 524 - DNA, 248 bp; single-stranded, linear
  immediate source library: BRSTNOT05
  immediate source clone: 2299185
ccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacact

SEQ ID NO: 525 - DNA, 232 bp; single-stranded, linear
  immediate source library: BRSTNOT05
  immediate source clone: 2303708
gtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggactgtgctgtcg

SEQ ID NO: 526 - DNA, 254 bp; single-stranded, linear
  immediate source library: NGANNOT01
  immediate source clone: 2306416
gaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaagggntcatgaaatcccaactgggaaaggtctaggcatggagaaacttccangctcctctgtgangcaggttttcnactcanaacantnaaccagggacgggc

SEQ ID NO: 527 - DNA, 126 bp; single-stranded, linear
  immediate source library: NGANNOT01
  immediate source clone: 2307314
aacaagatcgaacaggccatggatctggtgaagaatcatctgatgtatgctgtgagagaggaggtggagatcctgaaggagcagatccgagagctggtggagaagaactcccagctagagcgtgag

SEQ ID NO: 528 - DNA, 122 bp; single-stranded, linear
  immediate source library: NGANNOT01
  immediate source clone: 2309463
aaaacatgccaccatttatccaactgaagaggagttacaggcagttcagaaaattgtttctattactgaacgtgctttaaaactcgtttcagacagtttgtctgaacatgagaagaacaaga

SEQ ID NO: 529 - DNA, 244 bp; single-stranded, linear
  immediate source library: NGANNOT01
  immediate source clone: 2309843
caaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcattctg

SEQ ID NO: 530 - DNA, 260 bp; single-stranded, linear
  immediate source library: NGANNOT01
  immediate source clone: 2310743
ctgccatcccatggacatcctaggaacttgtgcaacagagcagtccagatgtctacgagcatacctggggctgattgggactgccatgacccccaactttgtcagcaatgtcaacaccagtgttgccttaagctgcacctgccgaggcagtggcaacctgcaggaggagtgtgaaatgctggaagggttcttctcccacaacccctgcctcacggaggccattgcagctaagatgcgttttcacagccaactcttctccc

SEQ ID NO: 531 - DNA, 228 bp; single-stranded, linear
  immediate source library: NGANNOT01
  immediate source clone: 2311280
aatcacaggacctccacccccatcaacaacatcttcggctgcatcgaaggccgctcagagccagatcactacgttgtcatcgggggcccagaagggatgcatggggcccaggagcaagctaaatccgctgtggggacggctatactcctggagctggtgcggaccttttcctccatggtgagcaacggcttccggccccgcagaagtctcctcnttcatcagctggga

SEQ ID NO: 532 - DNA, 240 bp; single-stranded, linear
  immediate source library: NGANNOT01
  immediate source clone: 2311543
cctgagcacagagctaggttttacnctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctat

SEQ ID NO: 533 - DNA, 242 bp; single-stranded, linear
  immediate source library: NGANNOT01
  immediate source clone: 2313466
accctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggcc

SEQ ID NO: 534 - DNA, 253 bp; single-stranded, linear
  immediate source library: NGANNOT01
  immediate source clone: 2314239
gagcgggccacgcagaggcaagaacgcttcgctgagaggccagccctcctggaactggagagattcgagcgcagggccctggaacgcaaggccgcagagctggaggaggagctgaaggccctgtctgacctccgcgctgacaaccagcgcctcaaggatgagaatgcagcgttgatccgcgtcatcagcaaactctccaagtgacccggaggactttcccgcacccgtatttatacagctgcttctgccacac

SEQ ID NO: 535 - DNA, 214 bp; single-stranded, linear
  immediate source library: NGANNOT01
  immediate source clone: 2314295
gggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttac

SEQ ID NO: 536 - DNA, 263 bp; single-stranded, linear
  immediate source library: NGANNOT01
  immediate source clone: 2314392
tnccagtnggacatctggnctctggnctgcatcatgtacacggtgctgactggcaccccacccttcatggcctcacccctgnnggagatgtaccaaaacatccgttangnccactacnccgancncgctcanctgtctgncaatnctcgctgcctcatngttcacctcctancacccanncnngcngatcnncccagcctggnccanctgctgcaggacgacttcttcatacagggtgtcactccagancggttgcngntcca

SEQ ID NO: 537 - DNA, 238 bp; single-stranded, linear
  immediate source library: NGANNOT01
  immediate source clone: 2314806
gggcctgctactgtgcccatgtgcccccaacgaccggggctgcggggagcgccggcgcaacaccatcgcccccaactgcgagctgccgcctgtngcccccaactgcctggagctgcggcgcctctgcttctccgacccgctttgcagatcacgcctggtggatttccagacccactgccatcccatggacatcctaggaacttgtgcaacagagcagtccagatgtctacgagcatac

SEQ ID NO: 538 - DNA, 251 bp; single-stranded, linear
  immediate source library: OVARNOT02
  immediate source clone: 2316650
accgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgattatctcatgagaatcaaaacatggcactttaccattagacaataccgngngttagtcccgagangcatcctagcnatgcatgcncangntcc

SEQ ID NO: 539 - DNA, 261 bp; single-stranded, linear
  immediate source library: OVARNOT02
  immediate source clone: 2320312
cttcttgcagcggcttctagagcagggcatccacagtgacgtggtctttgtagtacacgggaagccattccgggtgcatcgctgcgtcctgggtgcacgtagtncttactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcg

SEQ ID NO: 540 - DNA, 264 bp; single-stranded, linear
  immediate source library: OVARNOT02
  immediate source clone: 2323363
agtgacgccatcggcagctgcagcagaagagcggaaatgtcaaacgtggagggctgtgcctggctgctcctgagaaaactggaagatggtgtgccatgtcagatcacgaggccacgaagtgcaccagtttccgagacaatatgaaaaaagtgtttccagcagatggtccccttgtcacctgcgtggagagagcgtcttcccttgagtacattaaagccatcacagttaagtcactgctgcctaaaacacagtggaagaaagcca

SEQ ID NO: 541 - DNA, 261 bp; single-stranded, linear
  immediate source library: COLNNOT11
  immediate source clone: 2328550
gaggnntagctgacttttgccaaggagcagtgccaacnggcatggcatggtgccctgcctgcccccgggcgccacctctgtacacttccctgacaccttcccaggtgtgggtcactgccacctgtgcccatgggcaccccagagcacccactgtgaccactgcagttctctcatgcccaaaggnactggccatgtgaccttcgaaggggtcccggcccctccnacnantctagcntttctcaggctgaaccaaagattcca

SEQ ID NO: 542 - DNA, 216 bp; single-stranded, linear
  immediate source library: SINTNOT02
  immediate source clone: 233623
cacattctggcaagcagccttttgtatgcaaggngtgtgggcgaggcttcaactggaagggaaatctccttacacaccagaggncacactcaggggagaagcccttcgtntgtaatgtgtgtgggcaaggcttcagctggaagagaagtctcancagacaccactggcggatacactcaaaggagaagccttttgtttgccaggagtgtaagcntt

SEQ ID NO: 543 - DNA, 264 bp; single-stranded, linear
  immediate source library: TESTTUT02
  immediate source clone: 2342912
ccacngngagggaggtgtttgactggatcctggaccagggctactactcggagcgagacacaagcaacgtggtacggcaagtcctggaggccgtggcctatttgcantcactcaagntcgtgcacaggaatctcangctggagaacctggtttactacaaccggctgaagaactcgaagattgtcatcagtgacttccatctggctaagctagaaaatggcctcatcanggagccctgtgggacccccgagtatctggccccag

SEQ ID NO: 544 - DNA, 239 bp; single-stranded, linear
  immediate source library: TESTTUT02
  immediate source clone: 2344002
gttcacccaaattgtaaatatgatgcaaagtgtactaaaccagattgtcccttcactcatgtgagtagaagaattccagtactgtctccaaaaccagttgcaccaccagcaccaccttccagtagtcagctctgccgttacttccctgcttgtaagaagatggaatgtcccttctatcatccaaaacattgtaggtttaacactcaatgtacaagaccggactgcacattctaccatcc

SEQ ID NO: 545 - DNA, 244 bp; single-stranded, linear
  immediate source library: TESTTUT02
  immediate source clone: 2345776
atcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggt

SEQ ID NO: 546 - DNA, 257 bp; single-stranded, linear
  immediate source library: TESTTUT02
  immediate source clone: 2346805
ggccgcgggcggcgggcggcggaggtgcggggcctgctcccgccggcaccatggccaagaccgtggcctatttctacgaccccgangtgggcaacttccactacggagctggacaccctatgaagccccatcgcctggcattgacccatagcctggtcctgcattacggtctctataagaagatgatcgtcttcaagccataccaggcctcccaacatgacatgtgccgcttccactccgaggactacattgacttc

SEQ ID NO: 547 - DNA, 113 bp; single-stranded, linear
  immediate source library: COLSUCT01
  immediate source clone: 2348269
cagaagatggaccagatcatcgaaggtaacatgaaggcccactttattatggatgatccagcaggaaacagttacttgcagaatgtgtatgcgcctgaagatgatcctgagat

SEQ ID NO: 548 - DNA, 231 bp; single-stranded, linear
  immediate source library: COLSUCT01
  immediate source clone: 2348529
ggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcnaggctgtgggcatcaagag

SEQ ID NO: 549 - DNA, 247 bp; single-stranded, linear
  immediate source library: COLSUCT01
  immediate source clone: 2348983
ttctggctcatctcttgtaagatgttaaagttcttttcatgcaaatggaagggatcttagggcaactttaagtttgaaaaatataaaatgaatggaaagatttctaccaatttatctgttgcagggaagcaaaatacaaacaagagttggattattaatgttgctttgtacctggctaagcaattgtcccattgcagtaacgcattttcttcacaattnggngtaggtcnangncnnanatattngg

SEQ ID NO: 550 - DNA, 206 bp; single-stranded, linear
  immediate source library: COLSUCT01
  immediate source clone: 2349726
cagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcgg

SEQ ID NO: 551 - DNA, 297 bp; single-stranded, linear
  immediate source library: SINTNOT02
  immediate source clone: 235386
ggtgtgcctgnnnatgacaagtggtcccccgggntgaggaattcggcacgagcagaacattcaggatggaagcttggatctgaatgctgctgagtctggtgtacaacacaaaccttcagccccgcagagtgccgggctaaccagtgaaccccaaccccagagagaaggctgtggctgctagtgacctctttgctgtggcccctcatttgacctttcacctctgtctgttggaagcagtactttttttacttgcctcattggtcttcctgtnacatnctttaccttggggtttnaatt

SEQ ID NO: 552 - DNA, 257 bp; single-stranded, linear
  immediate source library: LUNGFET05
  immediate source clone: 2359101
ccgctactccgtgccgcgcccgtcgagcattgcgttgctgcattgcgccccaccgactccactatgttgaagaaattcgacaagaaggatgaggagtcaggtggaggctccaacccattccagcaccttgagaagantgcggtactccaggaggcccgtgtatttaatgaaactnccatcaaccctcngaaatgtgcccacatcctcaccaagattctttatcncntaaaacanggggagcaactggggaccacngg

SEQ ID NO: 553 - DNA, 241 bp; single-stranded, linear
  immediate source library: LUNGFET05
  immediate source clone: 2359895
gtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttnggagcatggtgttcaacgagggcgaggcccagcggctcatcgagatcctgtctgagaaggctggcatcatt

SEQ ID NO: 554 - DNA, 247 bp; single-stranded, linear
  immediate source library: LUNGFET05
  immediate source clone: 2361065
ctacatcattgagcaggcaggaggcttggcgaccacggggacccagcctgtactggacgtgaagcccgaggcaattcaccagcgagtccccctcattctggggtcaccagaggatgtgcaggaatatctcacctgtgtgcagaaaaatcaggcaggcagctagcgagtttgaccccacatgccctcttctgtttgtcttgcaccttgtctaaggaccctaaatgaacgataaacagagatggtagct

SEQ ID NO: 555 - DNA, 234 bp; single-stranded, linear
  immediate source library: LUNGFET05
  immediate source clone: 2361591
ggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctg

SEQ ID NO: 556 - DNA, 237 bp; single-stranded, linear
  immediate source library: LUNGFET05
  immediate source clone: 2361640
tgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattct

SEQ ID NO: 557 - DNA, 259 bp; single-stranded, linear
  immediate source library: LUNGFET05
  immediate source clone: 2362476
tgtntgtatcgcaaaaagatcaanaanacanagagtggcatgtatgcatgtgacttatgtgacaagacnttccagaaaagcagttcccttctgcgacataaatacgancacacaggaaaaagaccacatcagtgtcagatttgtaagaaagcgtttaaacacaagcaccaccttatcgagcactcnaggcttcactcgggcgagaagccctatcagtgtgataaatgtggaaagcgcttctnacactcgggctcgtact

SEQ ID NO: 558 - DNA, 240 bp; single-stranded, linear
  immediate source library: LUNGFET05
  immediate source clone: 2363031
gcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctg

SEQ ID NO: 559 - DNA, 237 bp; single-stranded, linear
  immediate source library: ADRENOT07
  immediate source clone: 2364091
cgctgtccacctgccaggtggagtgtatgtggctgtngccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgt

SEQ ID NO: 560 - DNA, 238 bp; single-stranded, linear
  immediate source library: ADRENOT07
  immediate source clone: 2365149
gtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagacc

SEQ ID NO: 561 - DNA, 209 bp; single-stranded, linear
  immediate source library: ADRENOT07
  immediate source clone: 2365675
ccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatct

SEQ ID NO: 562 - DNA, 233 bp; single-stranded, linear
  immediate source library: ADRENOT07
  immediate source clone: 2369983
atgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggag

SEQ ID NO: 563 - DNA, 226 bp; single-stranded, linear
  immediate source library: ADRENOT07
  immediate source clone: 2370163
caactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggntatgatgctgacagaacgcgtcgctgaagccccaaaggtttgcccg

SEQ ID NO: 564 - DNA, 233 bp; single-stranded, linear
  immediate source library: ADRENOT07
  immediate source clone: 2371406
gcactgccctccagacctcttccccacaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcanaagcagcagagcctgcagcggcactggagcanctcc

SEQ ID NO: 565 - DNA, 212 bp; single-stranded, linear
  immediate source library: ADRENOT07
  immediate source clone: 2372591
aagaagaggaatcttcaggaaacatttctaaggacctgaaagataaaatagtggagaaagcgaaaganancctggacacagcagcagttgtccaggtgggcataagcaggaatcagagccacagcagccccagcgtcancccagcagaagccacagtccttctggaagccagacccgaagccacagtagcagtgccagctcagcagaaagtc

SEQ ID NO: 566 - DNA, 220 bp; single-stranded, linear
  immediate source library: ISLTNOT01
  immediate source clone: 2373667
cttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaa

SEQ ID NO: 567 - DNA, 228 bp; single-stranded, linear
  immediate source library: ISLTNOT01
  immediate source clone: 2374748
caagagaatgcaaggccctgaagcagagaccacgatttgtagctttaaagaaacaacctgcatatttnggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcaca

SEQ ID NO: 568 - DNA, 212 bp; single-stranded, linear
  immediate source library: ISLTNOT01
  immediate source clone: 2375244
cgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatggtttttagcagctgtgccaaagtggggtagtgaagctattgagaagaaagcattgctgtt

SEQ ID NO: 569 - DNA, 242 bp; single-stranded, linear
  immediate source library: ISLTNOT01
  immediate source clone: 2375549
ctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatggaacctggaccaaaaatcaagggcccagtatcaagcccgatatatanagctatgcggtnatccca

SEQ ID NO: 570 - DNA, 205 bp; single-stranded, linear
  immediate source library: ISLTNOT01
  immediate source clone: 2378367
aaactcttttggcctgagacagaaaaacctaaaataaccctcaagaatgccatgaaaatggaaagtggaagctgcaacacagggagcatcctcctccatctccctggtggccaacatcgctgtgaatctgattgccttcctggccctgctgtcttttatgaattcagccctgtcctggtttggaaacatgtttgactacccacag

SEQ ID NO: 571 - DNA, 205 bp; single-stranded, linear
  immediate source library: ISLTNOT01
  immediate source clone: 2378372
agcaacatgaagttggcagccttcctcctcctgtgatcctcatcatcttcagcctagaggtacaagagcttcaggctgcaggagaccggcttttgggtacctgcgtcgagctctgcacaggtgactgggactgcnaccccggagaccactgtgtcagcaatgggtgtggccatgagtgtgttgcagggtaaggacagatgaagag

SEQ ID NO: 572 - DNA, 236 bp; single-stranded, linear
  immediate source library: ISLTNOT01
  immediate source clone: 2380464
gaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataaga

SEQ ID NO: 573 - DNA, 228 bp; single-stranded, linear
  immediate source library: THP1AZT01
  immediate source clone: 2394910
cttgggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggagg

SEQ ID NO: 574 - DNA, 233 bp; single-stranded, linear
  immediate source library: THP1AZT01
  immediate source clone: 2395359
gggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctgg

SEQ ID NO: 575 - DNA, 232 bp; single-stranded, linear
  immediate source library: THP1AZT01
  immediate source clone: 2395967
accaaactcattactgaggacaaggnagggggccttttcactgtgactctgtttcgaaaagtgattgaagatttcaaaaccaaggccaaagaaaacaagttcactgttcgtgaattttactatgatgagaaggaaattgaaagggaaagggaggagatggccagattgctgtctgataagaagcaacagtatggccccctgctgcgctggctcaaggtgaacttcagtgaag

SEQ ID NO: 576 - DNA, 236 bp; single-stranded, linear
  immediate source library: THP1AZT01
  immediate source clone: 2396336
cggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgc

SEQ ID NO: 577 - DNA, 230 bp; single-stranded, linear
  immediate source library: HNT3AZT01
  immediate source clone: 2414332
ggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagttttgacagtgac

SEQ ID NO: 578 - DNA, 187 bp; single-stranded, linear
  immediate source library: HNT3AZT01
  immediate source clone: 2415521
ccgtacacgagctcccgctgccgccgtgaactctactgcctgctgctggcgctgctgcnggccccgtctcctcgctgcccacctcctcttgcctgtgcccngcaagccttctccctcggccagcgagaagatagccttgaggtctcctctttctgctcagaagcactggtgacctgtgctgctctna

SEQ ID NO: 579 - DNA, 228 bp; single-stranded, linear
  immediate source library: HNT3AZT01
  immediate source clone: 2415970
gccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggccca

SEQ ID NO: 580 - DNA, 234 bp; single-stranded, linear
  immediate source library: HNT3AZT01
  immediate source clone: 2417796
ttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacc

SEQ ID NO: 581 - DNA, 219 bp; single-stranded, linear
  immediate source library: HIPONOT01
  immediate source clone: 241996
catcatttcagtgggtcaccaaatgggttgattactctaacaaatatggctttgggtaccagctctcagaccacaccgtcggttccttttcaacaatggtnctcacatgagcctccttncagacaaaaaaacagttcactattacgcagagcttggtcaantntcagttttcccancaacagatgntcctgagcaattttattaggtcaangtgncggt

SEQ ID NO: 582 - DNA, 215 bp; single-stranded, linear
  immediate source library: THP1NOT03
  immediate source clone: 2444978
cgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaga

SEQ ID NO: 583 - DNA, 216 bp; single-stranded, linear
  immediate source library: THP1NOT03
  immediate source clone: 2444995
acaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagt

SEQ ID NO: 584 - DNA, 236 bp; single-stranded, linear
  immediate source library: THP1NOT03
  immediate source clone: 2445310
aggagatggcagcagcagtgaacaaattcgaattccaaagatatcaaatgcctacgcgagaggatctggggcttccacttcgaatgcatgtacgctgtcagccatccagtacaataatgatttccctcacagctaggtccagtttatgacnaaagttanctgaaggacttgctgnttataatataagcannatttagctagttgttttgaagacacccagtactaagtaatattgt

SEQ ID NO: 585 - DNA, 1230 bp; single-stranded, linear
  immediate source library: THP1NOT03
  immediate source clone: 2445356
cggcggactggcccgcggtgggctaggggcagggccggagccgcggcggcggagtgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgc

SEQ ID NO: 586 - DNA, 240 bp; single-stranded, linear
  immediate source library: THP1NOT03
  immediate source clone: 2446605
ggcggtcgcgcggcctttcccactagccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaa

SEQ ID NO: 587 - DNA, 226 bp; single-stranded, linear
  immediate source library: THP1NOT03
  immediate source clone: 2446779
tggttctctacgggcagggtggacaggaagcagctcagcccagcctgggagaggccaagggctgcctcctatcagagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggactgaaccagcacctg

SEQ ID NO: 588 - DNA, 237 bp; single-stranded, linear
  immediate source library: THP1NOT03
  immediate source clone: 2447124
cggtttctgcgaaattaacatgattgaacttactccacccagaggttacacaaaacttccttttaaatggtttgactacctcagggaaactggctccattgcagcaccagtaaaactatttaataaggatgttccaaatcacggatttcgtgtaggaatgaaattagaagcagtagatctcatggagccacgtttaatatgtgtagccacagtaactcgaattattcatcgtctctt

SEQ ID NO: 589 - DNA, 230 bp; single-stranded, linear
  immediate source library: THP1NOT03
  immediate source clone: 2447742
cagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttg

SEQ ID NO: 590 - DNA, 229 bp; single-stranded, linear
  immediate source library: ENDANOT01
  immediate source clone: 2450425
gcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaag

SEQ ID NO: 591 - DNA, 233 bp; single-stranded, linear
  immediate source library: ENDANOT01
  immediate source clone: 2451140
ggaattttctttctttgacaaggtccgccggtgctgaagagccaggaggtgtatgaaaacttcctccgctgcatcgcactcttcaaccaggagctggtgtctggctctgagctcctgcagctcgtcagcccatttctggggtgagcagctgacttcccagggctccctaggggggttctgttcctgtcaactccatctacttggtttttagttactgtttttgagcaatgatt

SEQ ID NO: 592 - DNA, 229 bp; single-stranded, linear
  immediate source library: ENDANOT01
  immediate source clone: 2453340
gttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaa

SEQ ID NO: 593 - DNA, 258 bp; single-stranded, linear
  immediate source library: ENDANOT01
  immediate source clone: 2454062
cctgangcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggnaagcggaagacgctgaatgccagtgatgtgctctcagc

SEQ ID NO: 594 - DNA, 229 bp; single-stranded, linear
  immediate source library: ENDANOT01
  immediate source clone: 2455270
gggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtg

SEQ ID NO: 595 - DNA, 232 bp; single-stranded, linear
  immediate source library: ENDANOT01
  immediate source clone: 2458266
tcaactcctctccagccaagaagatgaccctcagcgagatttaccgctggatctgtgataacttcccctattacaagaatgctggcattggttggaagaattcaatacggcacaacctttctctcaacaagtgtttccggaaggtgcccagacctcgggatgaccctgggaagggttcctattggacaattgacacctgccctgacatttcccgaaagagaagacaccctcc

SEQ ID NO: 596 - DNA, 214 bp; single-stranded, linear
  immediate source library: ENDANOT01
  immediate source clone: 2458342
tttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcatt

SEQ ID NO: 597 - DNA, 223 bp; single-stranded, linear
  immediate source library: THP1NOT03
  immediate source clone: 2470285
caatctagcatgattaagcatgtcgcttggctaatcttcaccaattgnatctttttctgccctgtggcgtttttttcatttgcancattgatnactgcaatctctatcagccccgaaataatgaagtctgttactctgatattttttccattgcctgcttgcctgaatccagtcctgtatgtnttcttcaacccaaagtttaaagaagantggangttacnga

SEQ ID NO: 598 - DNA, 228 bp; single-stranded, linear
  immediate source library: THP1NOT03
  immediate source clone: 2471894
ctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcagg

SEQ ID NO: 599 - DNA, 239 bp; single-stranded, linear
  immediate source library: THP1NOT03
  immediate source clone: 2472278
cgaaggaggaagattgacttggttctttcttagtcctatatctgtagnatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgcnaactctgttattcagtagagagaagtgtacggct

SEQ ID NO: 600 - DNA, 236 bp; single-stranded, linear
  immediate source library: THP1NOT03
  immediate source clone: 2472462
cagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgacc

SEQ ID NO: 601 - DNA, 260 bp; single-stranded, linear
  immediate source library: THP1NOT03
  immediate source clone: 2472878
caaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggc

SEQ ID NO: 602 - DNA, 217 bp; single-stranded, linear
  immediate source library: THP1NOT03
  immediate source clone: 2473612
gttgggacgacagctttcttcacagaagtcagtgccgtgggtacccattttaaaatccctgccactttgggctatcgtagttgcacacttttcttacaactggactttttatactttattgacattattgcctacttatatgaaggagatcctaaggttcaatgttcaagagaatgggtttttatcttcattgccttatttaggctcttggttatgt

SEQ ID NO: 603 - DNA, 231 bp; single-stranded, linear
  immediate source library: SMCANOT01
  immediate source clone: 2475604
gctggcacgnncgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactgga

SEQ ID NO: 604 - DNA, 226 bp; single-stranded, linear
  immediate source library: SMCANOT01
  immediate source clone: 2475740
gccgactacaacagattggagccatggctttggaacagaaccagtcaacagattattattatgaggaaaatgaaatgaatggcacttatgactacagtcaatatgaactgatctgtatcaaagaagatgtcagagaatttgcaaaagttttcctccctgtattcctcacaatagttttcgtcattggacttgcaggcaattccatggtagtggcaatttatgccta

SEQ ID NO: 605 - DNA, 222 bp; single-stranded, linear
  immediate source library: SMCANOT01
  immediate source clone: 2480469
ggcggcccagcggcggcaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttg

SEQ ID NO: 606 - DNA, 304 bp; single-stranded, linear
  immediate source library: SMCANOT01
  immediate source clone: 2482853
cggcggaaaagttgcggggcatagacgagcggccccgggacgggcagctagcgcgaccctgagccggcgcccgtggtccggccatggacgacctcgacgccctgctggcggacttggagtctaccacctcccacatctccaaacgggcctgtgttcttgtcggaggangncccctactcatacccaatggaaaccacacataccaggagattgcngtncantngnnntnagnnganncccgtccagngaggccctcaatggcacaatccttgacccttagaccagtggcagcccagcggctncc

SEQ ID NO: 607 - DNA, 243 bp; single-stranded, linear
  immediate source library: SMCANOT01
  immediate source clone: 2483647
ggtgaacggcgtgctggtgctgagcctcctggacaaaatcatcggggccgtagacnagattnagctgcctcaagnacagctganaggagcgncaggcggngatgnagggcgcngtgcanagcatccagggcnanntgagnaagctgggcaaggcgcacgccaccacgagcaatacggtgagcaanctgctggagaaagtgcgcaaggtcagcgtcaacgtgaagaccgtgcgcggcnncctng

SEQ ID NO: 608 - DNA, 241 bp; single-stranded, linear
  immediate source library: CONUTUT01
  immediate source clone: 2502254
ctggactgactggcagactcggagcatccaccgtgctgacaagggtactggcagcaatgtcatcctcgtgaggtccaacctgccaggcctcatggacatgcaggctgtggaccgggcacagccactaggttttaacaagtgcggctcgagaaatggcggctgctcccacctctgcttgcctcggccttctggcttctcctgtgcctgccccactggcatccagctgaagggagatgggaag

SEQ ID NO: 609 - DNA, 192 bp; single-stranded, linear
  immediate source library: CONUTUT01
  immediate source clone: 2504131
ccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccc

SEQ ID NO: 610 - DNA, 236 bp; single-stranded, linear
  immediate source library: CONUTUT01
  immediate source clone: 2506506
agattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgta

SEQ ID NO: 611 - DNA, 254 bp; single-stranded, linear
  immediate source library: CONUTUT01
  immediate source clone: 2506976
ggcacatggagagacatgaatcaggggagtggactggacctgctgaagatctcatatggaaaaggagccagaaggaaaaacagatttaaaggatctgatggaagcacgtcatctgatactacctcaaatagttttgttcgccaggtaagagttttaagttcatggttttgataagtaccttaaaatgactttagatttttaaaggtgggtttcactcttttccttaagatttatgtagtatgattgtacttact

SEQ ID NO: 612 - DNA, 242 bp; single-stranded, linear
  immediate source library: CONUTUT01
  immediate source clone: 2507750
ttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcg

SEQ ID NO: 613 - DNA, 265 bp; single-stranded, linear
  immediate source library: CONUTUT01
  immediate source clone: 2507903
agattatgaggatgctacattccatgaaattgatattgaagctcaggatggtccgggccttctaaccagagcgaaggttatcgtcacggttctggatgtgaatgacaatgccccagaattttacatgacatctgctactagctcagtttctgaagactctcttccaggaaccataattgggctttttaatgtacatgatagagactctgggcagaacgcattcaccacctgttcactccccgaggatcttccttttaagttagaa

SEQ ID NO: 614 - DNA, 235 bp; single-stranded, linear
  immediate source library: CONUTUT01
  immediate source clone: 2508812
ggacgacaacagcatccagatgaagaaggacctgcagatgttcttgtatcacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccanacc

SEQ ID NO: 615 - DNA, 254 bp; single-stranded, linear
  immediate source library: CONUTUT01
  immediate source clone: 2509024
tgcagttctaaggagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttgg

SEQ ID NO: 616 - DNA, 239 bp; single-stranded, linear
  immediate source library: CONUTUT01
  immediate source clone: 2509610
ggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggantgcatggacgcctggntccaggctccaggctgactgggggcctc

SEQ ID NO: 617 - DNA, 304 bp; single-stranded, linear
  immediate source library: CONUTUT01
  immediate source clone: 2510184
gacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctt

SEQ ID NO: 618 - DNA, 345 bp; single-stranded, linear
  immediate source library: CONUTUT01
  immediate source clone: 2511250
aagaaatacagaagtccagaatgatcaaatgagatcactacccaatgaaatgataggccgaggagccagaaattgtcctactacctgctttccaggtccagattccacgagagccttctgggctcccaccagagaccctcagtgaagactctgttgaagactttaagaccatgctagaaagcctcccggcagaggttcaggaagttctgctatgaggatgcagctggccccagggatgtcctcaggcatctctaggaccttgctggacggtggtggctgagacctgatatccacacaaaggagcagactgtggaaatgctggtgcaggagcaattccaggctgtc

SEQ ID NO: 619 - DNA, 252 bp; single-stranded, linear
  immediate source library: PANCDIT01
  immediate source clone: 251188
gcgtccgccccgccnaaatggaggnggtggtgggancngnccgagaatttngngtntggggttggngggnaggccctgcngngggggggggaagtggncttctnttttttccggaggggncggtaaacctggtggctgaacggcaagatgaatttcctccgcggggtaatggggggtcagagtgccggaccccagcacacagaagccgagacgattcaaaagctttgtgacagagtagcttcatctacttta

SEQ ID NO: 620 - DNA, 299 bp; single-stranded, linear
  immediate source library: CONUTUT01
  immediate source clone: 2512273
cgcagggactgtttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgcnnnncccctgcagtccccgagcacaatcancncccctaaaggatgccctcggaccccaacaacactgcgagaggcctctgaccctgccactcccagtaatttcctgcccaagaatnaacccttgggtga

SEQ ID NO: 621 - DNA, 326 bp; single-stranded, linear
  immediate source library: LIVRTUT04
  immediate source clone: 2515448
ggagcacacaccgccagtctgtgcgctgagtcggagccagangccgcggggacaccgggccatgcacgcccccaactgaagctgcatctcaaagccgaagattccagcagcccangggatttcaaagagctcagactcagaggaacatctgcggagagacccccgangccctctccagggcagtcctcatccagacgctccgctagtgcagacaggngcgcgcagtggccccggctcgccgcgccatggagcggatccccagcgcgcaaccaccccccgcctgcctgcccaaagcaccgggactggagcacggagacctaccaggg

SEQ ID NO: 622 - DNA, 289 bp; single-stranded, linear
  immediate source library: LIVRTUT04
  immediate source clone: 2517151
gcggcggcagggctgagccagcgacgccctccattcactctccgcgcccgttctccggctgtcctcccgtttccgttgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcatgtccgcatccccaaggagcagggc

SEQ ID NO: 623 - DNA, 301 bp; single-stranded, linear
  immediate source library: LIVRTUT04
  immediate source clone: 2517343
cacccagggccgctaccgctgccgctcgggcttgtccacaggatggacccagctgancaagctcctgnagctgacagggccaaantccttgcctgctccctggctctcgatggcgccagtgtcctggatcanccccggcctgaaaacaacancagtgtgccgnggtgtgctgcggngtgtgacttttctnctgaggcggnagggcgaccatgagtttctggangtgcctgangcccagnaggatgtggaggccacctttccagtccatcagcctggcaactacagctgcagctaccggacc

SEQ ID NO: 624 - DNA, 357 bp; single-stranded, linear
  immediate source library: GBLANOT02
  immediate source clone: 2527954
gagagaggtgcccagcccgtgcaggacacgaagctgcatgtgtttgacgcaaacactctgacctggtcacagccagagacattggaaatcctccatctccccggcatggtcatgtgatggtggcagcagggacaaagctcttcatccacggaggcttggcgggggacagattctatgatgacctccactgcattgatataagtgacatgaaatggcagaagtaaatcccactggggctgctccagcaggctgtgctgcccactcagctgtggccatgggaaaacatgtgtacatctttggtggaatgactcctgcaggagcactggacacaatgtacccagtatcacacagaagagc

SEQ ID NO: 625 - DNA, 219 bp; single-stranded, linear
  immediate source library: GBLANOT02
  immediate source clone: 2528163
cgaagaatcaaattggaaattatggaatttgtgaatttcctgaagaatcccaagcagtatcaggacttaggagcaaaaattccaaagggagccatgctcactggtcctcctggtaccggcaagacccttcttgccaaagcaactgcaggggaggccactgtgcccttcatcactgtgaacgggtctgagttcctggaaatgtttattggcgttgggcca

SEQ ID NO: 626 - DNA, 302 bp; single-stranded, linear
  immediate source library: GBLANOT02
  immediate source clone: 2529044
ccggtctctagtagtgcagttcggctggtgtcatcggtgtccttcctccgctgccgcccccgcaaagcttcgcgtcatcgaggccatttccagcgattgtcgcacgcttttctatatattcgttccccgccaaccgcaaccattgacgcatgtcgggttattcgagtgaccgagaccgcggccgggaccgagggtttggtgcacctcgatttggaggaagtagggcagggccttatctggaaagaagtttggaaacctggggagaaattagttaaaaaagaagtggaatcttgatgagctgc

SEQ ID NO: 627 - DNA, 542 bp; single-stranded, linear
  immediate source library: GBLANOT02
  immediate source clone: 2529619
ggaccatcctggggctcatctcactggactccagactccacacccccatgtacttcttcctctcacacctggccgtcgtcaacatcgcctatgcctgcaacacagtgccccagatgctggtgaacctcctgcatccagccaagccccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactgcccttttgtgggcctcgtgaaatcaaccacttcttctgtgaaatcctgtctgtcctcaggctggcctgtgctgatacctggctcaaccaggtggtcatctttgcagcctgcatgttcatcctggtgggaccactctgcctggtgctggtctcctactcacacatcctggc

SEQ ID NO: 628 - DNA, 302 bp; single-stranded, linear
  immediate source library: GBLANOT02
  immediate source clone: 2530840
agcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaatcaaaatccaggcccaggaggacagagaaaaagggcagatgccccatacgtgactgctcggctcccccnntncaccccgccgcctctaatttatagcttggtaataaatttcttttctgcaaaaaaaaanngagngggnngnnngnnnnnnngnng

SEQ ID NO: 629 - DNA, 229 bp; single-stranded, linear
  immediate source library: GBLANOT02
  immediate source clone: 2531047
acaggttctgctgcctcttcaaaatcacaggatatcctttcccggcctacagtcagcctgacaatataagcaatgctataaatattatagcacatactgagaaatatgatggggcgctcagggtaggaaaacctagaagaatcgatcaggaaggtcagtactgtgaaggcagtggagatgaaacacaggctggcccacacagccatccagatatcagtgaactccttgg

SEQ ID NO: 630 - DNA, 235 bp; single-stranded, linear
  immediate source library: BONRTUT01
  immediate source clone: 2538191
ccagcacctgctgtccccagatgcccctgcagaagctgctcttcncnccnactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggt

SEQ ID NO: 631 - DNA, 243 bp; single-stranded, linear
  immediate source library: UTRSNOT11
  immediate source clone: 2544879
gaagtaggaaccacagcagtgggatggacgcagtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttc

SEQ ID NO: 632 - DNA, 242 bp; single-stranded, linear
  immediate source library: UTRSNOT11
  immediate source clone: 2545475
gctgcgacgtgactggctagctncgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatgg

SEQ ID NO: 633 - DNA, 258 bp; single-stranded, linear
  immediate source library: UTRSNOT11
  immediate source clone: 2547002
cagaaactgcattccagagacaaagtttagtgtgtacaaggctgnagttattttgcacattattttccctaaaacccacccatgaactgcattaacagcccaaaaaggcagagtgaatagaaggagtaaatctgctacagccaaattcaggatgtacacatctgtnttggttctctgtttcttgtaataggcataaattgccactaccatggaattgcctgcaagtccaatgacgaaagctattgtgaggaatacagg

SEQ ID NO: 634 - DNA, 259 bp; single-stranded, linear
  immediate source library: LUNGTUT06
  immediate source clone: 2549980
ccaagatgcagccgcccaccgagagccaggtgacctacctgcgacagatcgtgacggcaggcctgggggaccacttggcccgcaggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagc

SEQ ID NO: 635 - DNA, 254 bp; single-stranded, linear
  immediate source library: THYMNOT03
  immediate source clone: 2552764
ggggactatttttcccactcaactccatccccactccantctctggccaaattgtctatgtntgttcctcattgcttggtgagcagtggaatttttctggggtggctctgagatcagcgtgattgggtcgaagtgtgtggcatttggtggctgaggaagaactagagagagagcgactctccttggaacagggtttctaatgtcttagcatgttggtcttaagagttggttttgatgtctctcaacttgacctt

SEQ ID NO: 636 - DNA, 112 bp; single-stranded, linear
  immediate source library: THYMNOT03
  immediate source clone: 2552810
tgatgagatctgtgtgcaggtgactgacctttacctggcagaaaataataatggggccaccggaggccagctgaacacacagaactcaaggagcctcctggagtcaacgtat

SEQ ID NO: 637 - DNA, 267 bp; single-stranded, linear
  immediate source library: THYMNOT03
  immediate source clone: 2553280
gaaaaaaaaatctgtcaagtcataaaaaggctataggaatgatcntggtcgtgaccgctgcctttttagtcagtttcatgccatatcatattcaacgtaccattcaccttcattttttacacaatgaaactaaaccctgtgattctgtccttagaatgcagaagtccgtggtcataaccttgtctctggctgcatccaattgttgctttgaccctctcctatatttcttttctgggggtaactttaggaaaaggctgtctacattta

SEQ ID NO: 638 - DNA, 235 bp; single-stranded, linear
  immediate source library: THYMNOT03
  immediate source clone: 2553318
tttagacttaatcaagtacaatgacaacaggaaaaataagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcagg

SEQ ID NO: 639 - DNA, 159 bp; single-stranded, linear
  immediate source library: THYMNOT03
  immediate source clone: 2554189
gaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattaca

SEQ ID NO: 640 - DNA, 241 bp; single-stranded, linear
  immediate source library: THYMNOT03
  immediate source clone: 2554479
ccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctcc

SEQ ID NO: 641 - DNA, 242 bp; single-stranded, linear
  immediate source library: THYMNOT03
  immediate source clone: 2554757
aaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttgga

SEQ ID NO: 642 - DNA, 272 bp; single-stranded, linear
  immediate source library: BRAITUT22
  immediate source clone: 2586664
tgggacggcgaggagaccagctactgcttcaaggaaaagagtcgcagcgtgctgcgcgagtggtacgcgcacaacccctacccttcaccccgcgagaagcgtgantggcggaggccacgggcctcaccaccacacaggtcagcaactggttcaagaaccggcggcacgcgaccgggcggccgaggccaaggaaagggagaacaacgagaactccaattctaacagccacaacccgctgaatggcagcggcaagtcggtgttaggcagctcgg

SEQ ID NO: 643 - DNA, 266 bp; single-stranded, linear
  immediate source library: BRAITUT22
  immediate source clone: 2586678
gatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaa

SEQ ID NO: 644 - DNA, 265 bp; single-stranded, linear
  immediate source library: BRAITUT22
  immediate source clone: 2586966
ctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggagganttgctgagcgacatgaaggcggacgtgacccgcctgccagccacgctgtcccgaatacccccca

SEQ ID NO: 645 - DNA, 260 bp; single-stranded, linear
  immediate source library: OVARTUT02
  immediate source clone: 2594056
agtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaa

SEQ ID NO: 646 - DNA, 252 bp; single-stranded, linear
  immediate source library: OVARTUT02
  immediate source clone: 2596614
ggaagacctagcccggaatctaggcaagggcaagcgggttcgcaagcaagttaactacaatgatgctgctcaggaagaccaagacaaccagtcagagtactcggtgggttcagangaggaggatgaagacttcgatgaacgtcctgaagggcgtagacagtcaaagaggcagctccggaatgagaaagataagccactgcctccactgctggcccgagtcgggggcaacattgaggtgctgggcttcaacac

SEQ ID NO: 647 - DNA, 249 bp; single-stranded, linear
  immediate source library: OVARTUT02
  immediate source clone: 2597007
gcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagttttacggcatagggactacaaggtggacttggaatccaagcttgggaagacaattgtcattaccaagacaacccctcaatctgagatgggaggatattactgcaatgtct

SEQ ID NO: 648 - DNA, 275 bp; single-stranded, linear
  immediate source library: UTRSNOT10
  immediate source clone: 2599320
ctcaggatgtgatggtggtgggggancccaccctgatgngcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccataaaaggccctgctgtggccacccagtgtctgcctacttgccc

SEQ ID NO: 649 - DNA, 381 bp; single-stranded, linear
  immediate source library: HNT2RAT01
  immediate source clone: 259999
ggttttcaaaatgggagcccagaggcaccgcccaggctctcggaaggtgtcagggagaactttccgtggtttcagcgtcgtcgcctggagcggcggtttagagagccgagcctgatgggcgccaaggccggctggctgcttggagcgctgcctcgaagggactncgtgaaggaagctaatccggagaacccaggccagagcctggaaatatggcgacctgcatnggggagaagatcgaggattttaaagttggaaatctgcttggtaaaggatcatttnctggtgtctacagagctgagtccattcacactggtttggaagttncaatnaaaatgatagntangaaagccatgtacaaagnaggatggncacagagtcaaa

SEQ ID NO: 650 - DNA, 271 bp; single-stranded, linear
  immediate source library: UTRSNOT10
  immediate source clone: 2600088
gcgtggagaagggcgagctggccgaccgcgtggggaaggtgtccgtgttcttcaggaccagcccaaagcacaagctcaaaatcatcaaggctctgcaggagtcaggggcgatcgtggccatgactgcggatggggtgaacgacgcatggccctgaagtctgcagacattgggatcgccatggggcagacagggacggacgtcagcaaagaggccgccaacatgatcctggtggatgatgacttctcagccatcatgaatgcagtggangaa

SEQ ID NO: 651 - DNA, 283 bp; single-stranded, linear
  immediate source library: UTRSNOT10
  immediate source clone: 2601127
ctcacagcacatgtccctgacactgaggcttatggtttatgcaaganagtctcaaacttgccgtgcttcctattcagctggtgtcagagctaaccaggcatgggcctgtgaganaggggcggcaggagggaggtttgtgagagcgaggctgagcctacagatgaactctttctggccagccttcgttaantgngtagtacnatanaatttttaattgaagaaancngattanngccaaaaaaggttcgncccttaaaatantcccngtnnttttgggggnccc

SEQ ID NO: 652 - DNA, 359 bp; single-stranded, linear
  immediate source library: HNT2RAT01
  immediate source clone: 260827
ccgccatgttgaccgtgaccaccggccaggtgctaacctgtgacaagtgtccagcaggaacctatgtctctnagcattgtaccaacacaagcctgcgcgtctgcagcagttgccctgtggggacccttaccaggcatggggngggcatagagttttttncatgactntagtcagccatgcccatggccaatgaattgagaaatnaccttgtgctgccttgactgaccgagaatgcacttgcccacctggnangttccagtctaacgctacccgtgccccccanacggtgtgtccngtgggttgggtgtgcggaagaaagggacagagactgaggatgtgcggtgtaagcagtgtgcctc

SEQ ID NO: 653 - DNA, 253 bp; single-stranded, linear
  immediate source library: LUNGTUT07
  immediate source clone: 2608345
aggatgaagtggaaaaaggagaacaacaaggataaactgccgggagcccgagatgaggagaaggtggaggaagaaggaaatgangntnaggaganagangaggaggaaaaggaaganaacaaggactaagcaaaaaaganaganccccccccccttagcaactcccttgaagtttcgttttatggtagcagataaattgagaagtttacgactgtcatttgcttttatagagaatagaatgacactcacaact

SEQ ID NO: 654 - DNA, 257 bp; single-stranded, linear
  immediate source library: HNT2AGT01
  immediate source clone: 261759
tacgagaacaagctagttcctggtaatgacagcatctgcctggttcggtnaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacg

SEQ ID NO: 655 - DNA, 262 bp; single-stranded, linear
  immediate source library: KERANOT02
  immediate source clone: 2621425
cctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtttcctgctggggtcctgatgcctctgtttccaaacaaggtacaggttcagtccagactctttccccctgggaccaacagcagccagagcagttagccagttagtccccaggcctgtggccaca

SEQ ID NO: 656 - DNA, 377 bp; single-stranded, linear
  immediate source library: HNT2AGT01
  immediate source clone: 262183
cacgngtgcaccatcacatcactaaggtttttntccaacatgaacattctgatgaagtcgaaggcttgaggcctgactaaagcacatatcacactccctacacttccatgttttctctcccatgtggaccctctgatgcatatcaagattcaagcgcctgttgtagcccttcccacagtcctcacatttgtatggcttttctacactgtgaactttttcttgcacttcagagaatgaattctgtacaatgttcttcccatgctgctcacatttgngaggtgtttcttctgctgtggcgtcntaatgggtcaaacgagttgagggccagctaaagccnttcccaaaantcatcacattngnatggntttttttccngt

SEQ ID NO: 657 - DNA, 377 bp; single-stranded, linear
  immediate source library: HNT2AGT01
  immediate source clone: 262194
cagngtggtgacagcctctgggtcctcggtcggtacagtctctgcacctcgcgccccagcaggtaaacttaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttnatg

SEQ ID NO: 658 - DNA, 254 bp; single-stranded, linear
  immediate source library: KERANOT02
  immediate source clone: 2622817
gctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttca

SEQ ID NO: 659 - DNA, 260 bp; single-stranded, linear
  immediate source library: KERANOT02
  immediate source clone: 2623304
gcaagtttgcagttgtgatggctgacccaccctgggatattcacatggaactgccctatgggaccctgacagatgatgagatgcgcaggctcaacatacccgtactacaggatgatggctttctcttcctctgggtcacaggcagggccatggagttggggagagaatgtctaaatctctgggggtatgaacgggtagatgaaattatttgggtgaagacaaatcaactgcaacgcatcattcggacaggccgtacaggt

SEQ ID NO: 660 - DNA, 223 bp; single-stranded, linear
  immediate source library: PROSTUT12
  immediate source clone: 2626405
tccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagc

SEQ ID NO: 661 - DNA, 235 bp; single-stranded, linear
  immediate source library: PROSTUT12
  immediate source clone: 2626716
caaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtg

SEQ ID NO: 662 - DNA, 253 bp; single-stranded, linear
  immediate source library: PROSTUT12
  immediate source clone: 2626996
gcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgc

SEQ ID NO: 663 - DNA, 241 bp; single-stranded, linear
  immediate source library: COLNTUT15
  immediate source clone: 2630126
atgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagag

SEQ ID NO: 664 - DNA, 278 bp; single-stranded, linear
  immediate source library: COLNTUT15
  immediate source clone: 2633233
ggggtaganaggcacaggagcaggttctggcactggcgaatgaaaccgcttctcacacaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgt

SEQ ID NO: 665 - DNA, 250 bp; single-stranded, linear
  immediate source library: BONTNOT01
  immediate source clone: 2634993
tgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtggaggtggctgtgggggacaaagtccctgcagacatccgaatcctcgccatcaaatccaccacg

SEQ ID NO: 666 - DNA, 255 bp; single-stranded, linear
  immediate source library: BONTNOT01
  immediate source clone: 2636546
tggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgc

SEQ ID NO: 667 - DNA, 259 bp; single-stranded, linear
  immediate source library: BONTNOT01
  immediate source clone: 2638437
ggttcctggagtatganacgganctgacattcgtgggtgtagtgggcangctggaccctccgcgcaaggaggtcacgggctccatccagctgtgccgtgacgccgggatccgggtgatcatgatcactggggacaacaagggcacanccattgccatcngccggcgaattggcatctttggggagaacgaangaggtggccgatcgcgcctacacgggccgagagttcgacgacctgcccctggctgaacagcgggaag

SEQ ID NO: 668 - DNA, 223 bp; single-stranded, linear
  immediate source library: HNT2AGT01
  immediate source clone: 264357
gcantagtttttttggagatactccggagganctctttgggcaggtgatcagtgatgagattgtgtggcctgagggtgatgaggcactgcccccanacgcccaggacctcacctccaaactgctccaccagaaccctctggagaganttggcacaggcatttcctatgaggtgaagcagcacccattctttactggtctggactggacaggacttctccgcca

SEQ ID NO: 669 - DNA, 256 bp; single-stranded, linear
  immediate source library: OVARNOT09
  immediate source clone: 2645654
gttctagatcgcgatctagaactagtgtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattac

SEQ ID NO: 670 - DNA, 276 bp; single-stranded, linear
  immediate source library: OVARNOT09
  immediate source clone: 2645761
gctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaggtagagaagttggcattaaacatcaagagataccattcattcaacatatctatcagaagggcacgtccaccatcagcacaatgagatctcatactcaagaggatccttttctatgcaatga

SEQ ID NO: 671 - DNA, 366 bp; single-stranded, linear
  immediate source library: HNT2AGT01
  immediate source clone: 264733
gcacgtagatttcttggnaaataacagatgaagataagnaaaaaatccacaaaagacagatatgacaaatataaggaagttggggaacatccacctctgtnttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatnagtgtgggaagaccttcaggcaaacctcccagctcattgttcatctcagagcccacacaggggaaaaaccctatgantgcagtgagtgtggaaaggnctataggcacagctcccatctcatt

SEQ ID NO: 672 - DNA, 342 bp; single-stranded, linear
  immediate source library: HNT2AGT01
  immediate source clone: 264823
aagctcaacgaactcacctgcctactacctgancgacctggagcntattgcacagagtgactacatccccacacagcaagatgtgctacggacccgcgttaaagaccacggggntcgtggagacacacttcaccttcaaggacctacacttcaagatgttttttgtgggtggtcancggtctgagcggaagaagtggatccactgctttaagggcgtcacagccatcatcttctgcntagcttnagcgcctataanttggtgctagctgaggacgaggagatgaaccgcatgcatganagcatgaagctattcgatagcatctgcaacaacaagtggttggt

SEQ ID NO: 673 - DNA, 234 bp; single-stranded, linear
  immediate source library: LUNGTUT09
  immediate source clone: 2657496
caacatggggtccagcagcttcttggtcctcatggtgtctctcgttcttgtgaccctggtggctgtggaaggagttaaagagggtatagagaaagcaggggtttgcccagctgacaacgtacgctgcttcaagtccgatcctccccagtgtcacacagaccaggactgtctgggggaaaggaagtgttgttacctgcactgtggcttcaagtgtgtgattcctgtgaaggaact

SEQ ID NO: 674 - DNA, 239 bp; single-stranded, linear
  immediate source library: LUNGTUT09
  immediate source clone: 2658454
atcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttcca

SEQ ID NO: 675 - DNA, 363 bp; single-stranded, linear
  immediate source library: HNT2AGT01
  immediate source clone: 265958
gttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaatcacagatcctaaggtaatataatataattttngtgcatttctcctnatcaggaatgctggaggtgcattttaagttttaataataagtgctagaatgaccaaattgcagactaattgtttccatattgtacttaaaatgagtttttaaaagtgaaa

SEQ ID NO: 676 - DNA, 401 bp; single-stranded, linear
  immediate source library: HNT2NOT01
  immediate source clone: 266285
gtttctttctttacccaaagaaaatttcccaagcttcctcctgcctgcagaagctcctctactttaacctgtctgccatcaaagaaagggaacagttgacattggcccagctgggctggacttggggcccaattcttactataacctgggaccagagctggaactggctctgttcctggttcaggagcctnatgtgtggggccagaccacccctaagccaggtaaaatgtttgtnttgcggtcagtccnatggccanaaggtgctgttcacttcaacctgctggatgtagctaaggattggaatgacaacccccggaaaaatttcgggttattctggngatactggtaaagaagntagagnctcaggggtgaattttcagctnaagncacctgtgccaggc

SEQ ID NO: 677 - DNA, 443 bp; single-stranded, linear
  immediate source library: HNT2NOT01
  immediate source clone: 266495
cnaagtngtcccnctgggtttaggaatntggacgagaatctgacattgaaaagnagaagaacaagtnggtgaagtacaccaccatatttagtcataagagaatcnngtgaacttgagtcgaccctggagctccnggaaaatggcttggctngtgtgtctgccagtccaattgtggaacagcagctgccactcaggcgtaantcccaccnagaggagagtttnacatccaccgaagaatcttncgaagaaaatntcaacnttttgggtcagacagaggcacagtaccacctgangctgcacatccagatgcanctgtgttagntctcgtttgtnggatttgntaggcgngtggaatcannnggggncgggagtnagtngacgagtctncctggccttatgtaatggcaantgtttcaacaaaaatttttaaggattggtaggag

SEQ ID NO: 678 - DNA, 382 bp; single-stranded, linear
  immediate source library: HNT2NOT01
  immediate source clone: 268619
tccaggtggccatcaaagtgaattccccggaatcgtgtgctgggctggtcccccttgtnagactcagtcacatgcccactcgaagtcgcactgctatggaaagtgggtgcangtggtgggcaccctggcgtgatccgcctgggttgacttgttttgtnacaggagnttttcatgctggtcctcgnagcggcctttgcccgcccaggatctctttaactatatcacagaggaaggnccacttggtgaaggccccaagccgctngnttnttttgccaaaanagtggnagccattcnagnaatngcattcccnggggggtttntccatngnganatcaaaggntgggaaaaancttatangacctncngccgngggttttccaaa

SEQ ID NO: 679 - DNA, 345 bp; single-stranded, linear
  immediate source library: HNT2NOT01
  immediate source clone: 269479
cagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgnccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtnaacaaacaact

SEQ ID NO: 680 - DNA, 413 bp; single-stranded, linear
  immediate source library: HNT2NOT01
  immediate source clone: 269891
tgggcgaaatcaaaattcataaaatggagncaaaaggagaatgtgcccccaggtcctgaggtctgcatcacccatcaggnaaggggaaaagatttctgcaaatagaatagcctggcagtccgttccanccctgccgaagatgacgggggggaactcccantttntgagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctt

SEQ ID NO: 681 - DNA, 917 bp; single-stranded, linear
  immediate source library: HNT2NOT01
  immediate source clone: 270379
tncctgttgaccacgcgtccgccattcttctgcgcggtcgggtccgcggcctgcgctgtagcggtcgccgtcgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagnaggcagccgagatgctttatggattgatccacgcccgctacatccttaccaaccgtggnatcgnccagatgttgggaaaagtaccagcaaggagactttgggttactgtcctcgtggtgtacttgtgagaaccagccaatgcttcccattgggctttcagacatcccagggtgaaggcatggtgaagctcttctggcccaagtgcatggatgtgtcacaaccaagtcatcaaggacaacatcacacgggtggggctacttcgggaatggtttcctcacatgttcttcaagggggatccgagttaccggnccaagaganctgncaaccanttggggccaggttttcggnttaagatccacccnatggcttaccagttnaggttccaagccnccaggaaattcaangagcccagtcaanaaggatccggtgntccccccccccccgtcccggaagntttggnttttnccntnttttttgggcaccntncaggaaccccgntttgntttnngttnattaangaggngnnttnnnggggggattttanttaagtggnngtt

SEQ ID NO: 682 - DNA, 347 bp; single-stranded, linear
  immediate source library: HNT2NOT01
  immediate source clone: 270565
cgnccagcatcttgcggcggcacggctgaanccgctgctcgnnggccaagggccggccaagnagtgcaaaaaggaccaattccagtnccggaacgagcgctgcatcccctctttttggagatgcnacgaggacgatgactgcttagaccacagcaacgaggacgactgccccaagaagacctgtncagacagtaacttcacctgtaacaacggccactgcatccacgaacggtggaagtttgacggcnaaggaggagtntcctgatggctccaatgagtccgaggccanttncancaagcaggtttttcccncananaagctnagctttngacccancagcacaagt

SEQ ID NO: 683 - DNA, 265 bp; single-stranded, linear
  immediate source library: OVARTUT05
  immediate source clone: 2725053
ccgacgcggcgaaggagcgcgccatggagcatgtgacagagggctcctgggagtcgctgcctgtgccgctgcacccgcagtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagt

SEQ ID NO: 684 - DNA, 238 bp; single-stranded, linear
  immediate source library: OVARTUT05
  immediate source clone: 2726431
cccgcctgcccctagcggtccctggngtcccggttcctgtcgcgctcacctgcnccggtagcgaagaaatcgccccgggacatggactcagtggtctttgaggatgtggctgtggacttcaccctggaggagtgggctttgctggattctgctcagagggacctctacagagatgtgatgctggagacctttcagaacctggcctcagtaggaaaaatttgggacagtcttagcatcg

SEQ ID NO: 685 - DNA, 247 bp; single-stranded, linear
  immediate source library: OVARTUT05
  immediate source clone: 2729155
ggtggccgcgctgctgcctccccggggccgaaggagtgccaacgacgagctcttccgggcgggctccagactcaggcgacactggccaagctggccatcatcttcagccacatgcacgcagagctgcacgcactcttccccgggggaaagtactgtggacacatgtaccagctcaccaaggcccccgcncacaccttctggagggaaagttgcggacccggtgtgtgtgccctgggcatgagttttt

SEQ ID NO: 686 - DNA, 255 bp; single-stranded, linear
  immediate source library: OVARTUT04
  immediate source clone: 2729621
ggcggactgctgtgcagtggaacgcgctgggccgcgggcagcgtcgcctcacgcggacagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgttt

SEQ ID NO: 687 - DNA, 802 bp; single-stranded, linear
  immediate source library: PANCDIT03
  immediate source clone: 273061
gtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctcca

SEQ ID NO: 688 - DNA, 242 bp; single-stranded, linear
  immediate source library: OVARTUT04
  immediate source clone: 2730802
gtggagagaaactatttaagtgtaaagaatgttcaaaagcctttagccaaagttcagctcttattcaacatcaaataacgcatactggagagaaaccctacatatgtaaagaatgtgggaaagcctttactctcagtacatccctttataaacatctaagaacccatactgtggagaaatcctacagatgtaaagaatgtggtaaatccttcagccgaagtcaggcctttttatacatcaaa

SEQ ID NO: 689 - DNA, 227 bp; single-stranded, linear
  immediate source library: OVARTUT04
  immediate source clone: 2732557
ggccccagccgccattttctcgccgcttgtgtggctcgctggctgcgtggctcggttcttgtgagcgaattttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaattt

SEQ ID NO: 690 - DNA, 224 bp; single-stranded, linear
  immediate source library: OVARTUT04
  immediate source clone: 2733660
ggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccccgga

SEQ ID NO: 691 - DNA, 261 bp; single-stranded, linear
  immediate source library: OVARTUT04
  immediate source clone: 2733865
gggagccctgggctactctgtcacagcccctgttgccctgcgatctgtaggtccttggggacgcatagttaaggtgccaggacatcctggaagctgggaaatgatttcttccagaccatggctggagaaggaaagaaggtgtgttttgcctgactcagtgactatagagagaaccaagttctgcaggcctgtcacctaagtctcaggtgagtatgaattctcttgtgtttttcacagattgttgcagtggcaggaccaagg

SEQ ID NO: 692 - DNA, 261 bp; single-stranded, linear
  immediate source library: OVARNOT09
  immediate source clone: 2735796
gcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgttt

SEQ ID NO: 693 - DNA, 238 bp; single-stranded, linear
  immediate source library: OVARNOT09
  immediate source clone: 2738710
gggtgcagaagcgagtccgcgtgcggagccaggaggcagcgtcgcgtgggagtgctggcctgaagcctccatgccccggcagagggacggaacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacacctgtacgtgc

SEQ ID NO: 694 - DNA, 236 bp; single-stranded, linear
  immediate source library: OVARNOT09
  immediate source clone: 2739189
gttctctttgagtcacagaaaaanacacagaaatgtgcaatgtcatgatgcagttgaggaaaatggccaatcatcctttattacatcgccaatattacacagctganaaactcaaggaaatgtctcagcttatgctaaaggaacctacacattgtgaggctaaccctgacctgatctttgaagatatggaagttatgacagacttcgaactacatgtactttgtaaacagtaccga

SEQ ID NO: 695 - DNA, 254 bp; single-stranded, linear
  immediate source library: OVARNOT09
  immediate source clone: 2739264
cgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactgatcatatctgaagatattagtgagctacaaaagaatcaaactacatctgtagccaaaattgcacaatacaagaggaaactcatggatctttcccataga

SEQ ID NO: 696 - DNA, 397 bp; single-stranded, linear
  immediate source library: TESTNOT03
  immediate source clone: 276815
gcaccggcagaagctggagaaggacaagaggaggaaaaagaggaaggagaaggagaagaagggcaagcgccgncacagctcgctgcccacggagagcgacgaggacatcgnccctgcccagcaggtggncatcgtcacagaggagatgcctgagaatgctctncccagcgacgaggatgacaaagaccccaacgacccctacagggctctggatattgacctggataagcccttagccgncagcgagaaactgcctattcagaaacacagaaacaccgagacctcaaaatcccctganaaggacgttcccatngtngaaaggatgttcaagnaacccnngatgtngtgantnatcnacaatngngangnnnnatgncaaaggtgaagganggaagnt

SEQ ID NO: 697 - DNA, 214 bp; single-stranded, linear
  immediate source library: CARDNOT01
  immediate source clone: 283526
ccacaggtggtganggtttatacttcccaccngatgatgaaaccctcagantggaggnnacaatttacagtaagagaaaagggtccccgagatgggaagaaaaccaaatacggcagcagggcaatacatgttgatgttcctggtgaaggtgtcacagaaggtttccngaagaaattaggaatttccncatcttnaagcaggtcattttaaggnt

SEQ ID NO: 698 - DNA, 334 bp; single-stranded, linear
  immediate source library: EOSIHET02
  immediate source clone: 288246
cagtctagttgctactttatttctactgggatgcaatcttggactaagagtcaaaagaactgttctgtgatgggggctgatctggtggtgatcaacaccagggaagaacaggatttcatcattcagaatctgaaaagaaattctncttatttnctggggctgtcagatccagggggtcggcgacattggcaatgggttgaccagacaccatacaatgaaaatgtcacattctggcactcaggtgaacccaataaccttgatgagcgttgtgcgataataaatttccgttcttcagaagaatggggctggaatnacattcactgtcatgtacctt

SEQ ID NO: 699 - DNA, 331 bp; single-stranded, linear
  immediate source library: TMLR3DT01
  immediate source clone: 292734
ggtcgnactacgaacagattttttctgtataaggagggagaacgtgaacttcctccagcgccctggttggcagccccaggctgggctctcccaggccaacttcaccctgggccctgtgaagcccctcccacgggggccaggtanngnngctacantttnnacaacctctcctccgagtggtcggcccccagtnaccccctggacatcctgatcacaggacagttctatgacagaccctctctctcggtgcanccggtccccanagtagccccaggaaagaacgtgaccctgctgtntcaatcacggggggcaattncanantttnnttctg

SEQ ID NO: 700 - DNA, 373 bp; single-stranded, linear
  immediate source library: HEARNOT01
  immediate source clone: 305077
gncagagacaagttgttcccactgagctctcctcagaattacagattggtgatacatcacaggggctcatgaatgtntcttaagctgggtcattgaagtggaatgttttcacaagacctcctccacttgctactgtgtccggaattggtgggttcttggtctcactgacttcaagaatgaagccgcggaccctcgcgggagtggcaaatcaaaggcattgcagcctctttcatcantgccgattgctgatgccaaccatgtgccaagtgcttaatangtcaccttaaatcttctcatncaccctcagagtagcttcagcaanaacccagtgccctgactttnaagacggctttttaaacaccccaactttttt

SEQ ID NO: 701 - DNA, 710 bp; single-stranded, linear
  immediate source library: HEARNOT01
  immediate source clone: 305403
agacaaggaaatatgtcatactttgtcaaaagrcagtttatccaatggagtgcctagtggcagacaagcagaattttcataagtcctgcttccgatgccaccattgcaacaktaaactaagtttgggtaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctaggagatgttaggactccaggaaataaaggncaaaggcaaggancactttccatttttgccagccttatctnccagtccaccccatgtttgncaggaagngggttgttttnggggtccaagggaatggaaaatgcccttaaggggagggaaaggtt

SEQ ID NO: 702 - DNA, 232 bp; single-stranded, linear
  immediate source library: HEARNOT01
  immediate source clone: 306020
ngggtgcctnnggaactgtcaaattatggaccccggagaaaaaaatgcagtgtaagaagcgttggaagnaggtttttatctgagcttgaagttttactactgtttcatcacccaaacatactagagttggctgcatattttacagagactgagaagttctgtctgatttatccatacatgagaaatggaacactttttgacagattgcagtgtgtaggtgacggnanttttn

SEQ ID NO: 703 - DNA, 923 bp; single-stranded, linear
  immediate source library: HEARNOT01
  immediate source clone: 307624
gggggggggggggnnntgggtntnggntctctannnccctntaanaaaggcggcccctggccaaaagctcanttttttcctnttcctccaccgccaccaccaccaccaccgccncctttgccngaccccacacccccggagccagaggaggagatcctgggatcagatgatgaggagcaagaggaccctgcggactactncnantgtggatatcatccagtgaaaattggagacctcttcaatggccggtatcatgttattagaaagcttggatgggggcacttctctactgtccggctgtgctgggatatgcaggggaaaagatttgttgcaatgaaagttgtaaaaagtgcccagcntttttntgatacagccttggatgaaataaaattgctcaaatgtgttcgagaaagtgatcccagtgacccaaacaaagacatggtggtccagctcattgacgactttaagatttcaggcatgaatgggatacatgtctgcatggtcttcgaagtacttggccaccatctcctcaagtggatcatcaaatccaactatcaaggcctcccagtacgttgtgtgaagagtatcattcgacangtccttcaagggttagattacttacacagtaagttgcaagatcatacntactgacataaagccggaaaatatcttgatgtgtgtngaagangcatatttaanaagaatggcactgangccctgattggcanaaagcaggtgctccnctccctcagggtctgcantgaattacggtccccngcnaaaactntnggaaaaattctaaaaccnnngaaaaactgaaaanaaccnaaaagncggtgaattttttggaaaacccngccggaaaaaaaaaattggaccagaactgaanggaatttttaaaaaactccccccnnncccccccn

SEQ ID NO: 704 - DNA, 211 bp; single-stranded, linear
  immediate source library: TMLR2DT01
  immediate source clone: 309628
aaacgcgccangcccatcgaggtgctctgcgagaacttcccagaggagatggccacgtacctgcgactatgtgcggcgcctgggacttcttcgaggaagcccnactatgactacctgcggaagctcttcaccgacctcttcgaccgcagtggcttcgtgttcgactatgagtacgacttggccgggaagcccctgccgacccccatcggca

SEQ ID NO: 705 - DNA, 188 bp; single-stranded, linear
  immediate source library: LUNGNOT02
  immediate source clone: 312069
cctaatatcaatnttaaaaagttttcgngtaaataattaggtanactangcngccccagagataagncctcctggcatcattgtcccttcttatggagtgataatgtaaccttccttgaagtgtatcantccntcaccagtcaagttgccncagcctatgcactggacttgaatggaaaatgtggtgg

SEQ ID NO: 706 - DNA, 246 bp; single-stranded, linear
  immediate source library: LUNGNOT02
  immediate source clone: 313542
ccanaggacgccctacacttacaacaagagctgtgacttgtggtccctaggggtgattatctatgtgaatgctgtgcggntaccctcctttttactncaaacancacagccgggctatcccaaaggatatgcgaagaaagatcatgncaggcagttttnagttcccagaggaagagtggagtcagatctcagagntggccaaanatgttntgaggaagctccttcnaggtcaaaancnncgggggg

SEQ ID NO: 707 - DNA, 368 bp; single-stranded, linear
  immediate source library: EOSIHET02
  immediate source clone: 320054
ggcccccaaaccttcttcccggaccctcactggaagagatcctgctggacccctgggatgcaaacaccagccgaggatgtacccctcaacccctncaaaggaggccctgcccctttggcctggtccttgctaccctaagcctggnctggnctggcccccaatggtcagaagagccatcccatggccatgtcacagggatagatggacatttgttgacttggttttacaggtcattaccagtcattaaagtccagtattactaaggtaagggattgaggatcaggggttagnagacataaaccaagtctgcccagttccnttcccaatcctacaaaggagcctttcttccagaacctgtggtccctgat

SEQ ID NO: 708 - DNA, 386 bp; single-stranded, linear
  immediate source library: EOSIHET02
  immediate source clone: 320206
ctggtggtggnccntgcggnaannntggntnncccgggnctgncagtattcggtcagngggtgncctggagagcagccggggaccgcctccaggggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaattaaaaaaanaaaaaaaaa

SEQ ID NO: 709 - DNA, 255 bp; single-stranded, linear
  immediate source library: EOSIHET02
  immediate source clone: 322206
cacgcagatttcaaaatccattgtgtttgagtttgtttgcagttccctcagcttgctggtaattgtggtgtttngtttttggtnttgttttcaatgnaaatgtgatgtaatattctnatttnctttggatcaaagntggactggaaattgtatcgggtaattnttttngtgttcttaatgttatttggtactcangtngtaaataacggctactactgnttatnccagtttctactacctcaggtgncccatagg

SEQ ID NO: 710 - DNA, 1430 bp; single-stranded, linear
  immediate source library: EOSIHET02
  immediate source clone: 334703
cgaccgtcgggagctcggactcctacgnagtcaccgggaagggccgccgccccgcccgcggctgctggcccgggtgacacttccgsctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaac

SEQ ID NO: 711 - DNA, 241 bp; single-stranded, linear
  immediate source library: EOSIHET02
  immediate source clone: 334957
aatctgtccttcttcctgactccaccatgtgcacgatgggctcagctttcagaagtgctgagttggcagttttnttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctag

SEQ ID NO: 712 - DNA, 913 bp; single-stranded, linear
  immediate source library: NEUTFMT01
  immediate source clone: 339963
gattgggatancananaaagctggggacatgaaagctatcgtggaagtcacaagcggaagtggagatctcatagtagcacacaagagaacaggcattgtaaaccacatcaccagtttaaagaatctgattgtgctccatgtgcatccctcttgaagcttcgcactctgttgaagaggacactcatcccagtcattatttagaagcaaggtccttgaatgagcgagattatcgggaccggagatacgttgacgaatacnggaatgactactgtgaaaggatatgttcctagactttatcacaganaacnttgaaaagcgggtatcgaaatccactgcagtaaatcttcantccgcancagganaaaccanncctgaaaaggaancgcantaaaccctgttcaanttcttccattccctttcgaatnanatcgtggacnctttgggtngaagganccttnggcaaattgntnaattccttgatcttggctngaatggcttcntgttncnntgaaaatccttaaaaatgtttgccgttaccggtgaagcactccttcaaaatccaattttaganccttaaatagtactgatcccataatgttctccgatgttgtccagatgctanaatggtttgatcatccatggtcntttttgtnttgtgtttgaactactgggacttattacttncaattccttnaagaaaacgcttctgcctttccaattgaccncttccggcaaatgggtttccatntgccntcaataaattgtnnttccttgaaaaacctnattttaatnatnantnatnantnatttgaaaggatcccccnntccccngnggatncntggnccccggtccnnanccnccccgggtccccctttcnncncncccccattctggaatanggccccccntncc

SEQ ID NO: 713 - DNA, 1286 bp; single-stranded, linear
  immediate source library: NEUTFMT01
  immediate source clone: 342106
cttcccgcacctgatcgcgagaccccaacggctggtggcgtcgcctgcgcgtctcggctgagctggccatggcgcagtgtgcgggctgaggcggagcgagcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagataaatttcagcatgtgctttc

SEQ ID NO: 714 - DNA, 339 bp; single-stranded, linear
  immediate source library: NEUTFMT01
  immediate source clone: 342411
ttttcncgcgtncgggcctctttnncaggatgctgccgganngcaagagctccttgatcctcatggcttacatcatcatcttcctcactggcctccctgccaacctcctggccctgcgggcctttgtggggcggatccgccagccccagcctgcacctgtgcacatcctcctgctgagcctgacgctggccgacctcctcctgctgctgctgctgcccttcaagatcatcgaggctgcgtcgaacttccgctggtacctgcccaaggtcgtctgcgccctcacgagttttggcttctacagcagcatctactgcagcacgtggctccggggaaaaannn

SEQ ID NO: 715 - DNA, 163 bp; single-stranded, linear
  immediate source library: THYMNOT02
  immediate source clone: 343904
gccaggtggcatcccgttcatcttgactggtgagttcttccagcaatctcagcggccggctgccttcatcattgcaggnaccgtcaactggctctccaactttnctgttgggctcctcttcccattcattcagaaaagtctggacacctactgtttcctagtt

SEQ ID NO: 716 - DNA, 457 bp; single-stranded, linear
  immediate source library: THYMNOT02
  immediate source clone: 345221
caagatcagcgactttggnctctncaaagcactgggtgccgacgacagctactacactnaccgctcagcagggaagtggncgctcaagtggtacgnacccgaatgcatcaactnncgcaagttctacagccgcagcgatgtctggagctatggggtcaccatgtgggaggncttgtcctacggacagaagncctacaagaagatgaaaggnacngaggtcatggacttcatcgagcagggcaagcggatggagtanccaccagagtgtacacccnaactntacggactcatgagtgactnctggatctacaagtgggagnatcgacccaacttncngaccntagancagcggaatncgancctgttacttcaagcctnggccagcaaggttgaaggacccccagggagcacacagaaggcttaggcttccnannccttaanttccaatacccanggt

SEQ ID NO: 717 - DNA, 1236 bp; single-stranded, linear
  immediate source library: THYMNOT02
  immediate source clone: 346874
cagctcatgcttctctgaagacttgcagcaaggcttgctgaggctcacagaagatagccccagtgttttggagtggttttgaatgtgattctgagatcagactgactgagctggaatcctggctttatatcttaccagctacwcaaccttggagtcttagaaattttttcttttcartaagcagtcatccttactttccctcaagatgacaaacagttcgttcttctgcccagtttataaagatctggagccattcacgtattttttttatttagttttccttgttggaattattggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaarctgaagatattccactgccaagtaacagcctgcctcatctatatcaatatgtatttatcaattatcttcttagcatttgtcagcattgaccgctgtcttcagctgacacacagctgcaagatctaccgaatacaagaacccgggtttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataaaagacaggattttttgtgctaccaattctggccttactggaccataaagttaattatagctttgaaagata

SEQ ID NO: 718 - DNA, 232 bp; single-stranded, linear
  immediate source library: LVENNOT01
  immediate source clone: 348485
cagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaa

SEQ ID NO: 719 - DNA, 255 bp; single-stranded, linear
  immediate source library: SYNORAB01
  immediate source clone: 358600
ccttggcccttgcctctgcnccgttccnaccggagngtcatcngnccgggcgcaaccanacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactacc

SEQ ID NO: 720 - DNA, 1073 bp; single-stranded, linear
  immediate source library: PROSNOT01
  immediate source clone: 364214
tggcagccgccctgcccgccagaaagtttccccctaagtttgctgggcgcgggcgcacgactgactggctggaccatgaacgtgttccgaatcctcggcgacctgatccacctcctggccatgatcttgctgctggggaatatctggaggtccaagtgctgcaagggcatctctgggaaaagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgtnctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactnttttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccaactgcacaaagatggtgcctcactgcaacaagaaaccttaaggtgtcttaccgacgnaataaaaaacataaatgattgttctcctcttagaatgtcccaactaaagaccagttaaaatattagggtacgttcttgtg

SEQ ID NO: 721 - DNA, 392 bp; single-stranded, linear
  immediate source library: PROSNOT01
  immediate source clone: 364680
ccgcgtcgacagaagaagtagagcaggtggaccaggtggcagtggagggagatgtgggtcccatgcagtgtgagcagcagcagggtcacatgatagggcagccagcacatgtcaaagacggccacgtaggcgcacagcagcaggcagtggcgccggctcttgggttgtcctggctgccgcagccggcaggctgtcagcacattgaagactgtnatgagagggaaggncagcaggaagcccaggattgtggtggacagggccaccgncaggncccaggtgctgtacgtttcaaaaggtnccattnagaggcacatnggctnagggcccttcaccagctngnttttgaccactnaggcaagcggntttttgccgagaggaccccaganttnttt

SEQ ID NO: 722 - DNA, 658 bp; single-stranded, linear
  immediate source library: PROSNOT01
  immediate source clone: 364702
nnncttnngncnctncnttnttgntcnnttacaaatnnatganggcggnccncggntantagcnatcngtcaccctctatatcattaatccatcatgaacctgtgtttctgtggcttactacttttgctgtctttttnnatgctcagtcttataaactcccncctgttnaacattaattgccttacnantnacctgctncaaggaggtgnacatccctaattnctcctgtaacntttntcnantcccccanctngccgttgtgacaccttcatcaanaacataatcatntntttccctactgccataattggtttnctncccanctcggggacccaggtnctattattataaaatngttncnnncattcnnagggttccancnncaggtgggaantataaagcctnctccacctgtgggtctcaccctgtcaatggtttgctgtggnagggntacctcggttcaaanatttcntcttcccccaaaaagggtgcacctggctgcattnatgttncacggtggtcggctcnatgctcaacccctttatctacagccngggaaacagggatattaaaagtgtcttggcggcggccgctctaaaagatccctcnaagggcccaagcttacccttgcatgcaaantcatactcctncctanga

SEQ ID NO: 723 - DNA, 209 bp; single-stranded, linear
  immediate source library: PROSNOT01
  immediate source clone: 365524
ccggtcgacagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgat

SEQ ID NO: 724 - DNA, 243 bp; single-stranded, linear
  immediate source library: SYNORAT01
  immediate source clone: 365909
cgctgnttagctgtgctgggccggggacactttgggaaggtcctcctggtccagttcaaggggacagggaaatactacgccatcaaagcactgnagaagcaggaggtgctcagncgggacgagatagagagcctgtactgngagaagcggatcctggaggctgtgggctgnacagggcaccctttcctgntctccctccttgcctgcttccagacctccagccatgcctgctttgtgactgat

SEQ ID NO: 725 - DNA, 831 bp; single-stranded, linear
  immediate source library: SYNORAT01
  immediate source clone: 370076
aacaacnggccaaaacctatatgtgtaanaaatatgataagggtttttttagtagattagaacttactcnacataaaagaattcatactggtaagaaatcttatgaatgtaaagaatgtggaaaagtttttcaacttattttctactttaaagaaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaggaccttcagacttantttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgttgagaangcttttagttatagtggtgacctccgaattacattctagaattcatactggaganaaccatatgaatgttaggaatgcgggaaacccttatgcttccttccatccttactgggacatccganactcatactggtgttgaacccnacaatgtttagggatgttgggaaaacctccatntccttncncattatcctccttagaaatncaccanttnaccccccantnttcaaattggaacacttaaatgggtcccctccgacccnaaatcncnggtgaaacccataattaaaattgaagnttttcntnaaggacctaagacnngaaatctctgttaaccntgacgtaaaatggatcttatcgctngnngg

SEQ ID NO: 726 - DNA, 245 bp; single-stranded, linear
  immediate source library: LUNGNOT02
  immediate source clone: 372512
aaagcattctcttggctcacttgctttctacggcatgaaagaattcacatgagagagaaaccctatgagtgtcaacaatgtggtaaagccttcactcattcccgttttcttcaaggacatgaaaaaacttcatactnggagaggaacccgtatgaatgtaaggaatttggggaaagcatttgcttctctcagttccttgcaataggaccaataaaaaagggcttcacttggaaaaaaaaacttca

SEQ ID NO: 727 - DNA, 224 bp; single-stranded, linear
  immediate source library: LUNGNOT02
  immediate source clone: 373116
acagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcag

SEQ ID NO: 728 - DNA, 269 bp; single-stranded, linear
  immediate source library: NEUTFMT01
  immediate source clone: 375659
gctggacaaagctttctcttttctccctccttcacattcctaggntgctaaacancttgacgatcagaaactaaatggtgctgcctcttggacggagatcactgagggtgaatgagacaactgtgatttaaaagaccgaaagacgttttcccatgtgcttttgtgccatcttgagtgtcagagacagatccctgcaaggcccttcctaccttgcgctaagaaatcagcaaggagtgtcacctaactggatggaggacattagtgcttct

SEQ ID NO: 729 - DNA, 258 bp; single-stranded, linear
  immediate source library: NEUTFMT01
  immediate source clone: 377292
caggcctcagagtgtgtcgtgtgcctggaacgggaggcccagatgatcttcctcaactgtggccacgtctgctgctgccagcagtgctgccagccactgcgcacctgcccgntgtgccgccaggacatcgnccagcgnctccgcatctaccacagcagctgagtgctgcccgcccacctgggcctggtcctagccctgcctcggccactgtgagccccgggctcctgctcagccttgtgccagccagactcgtatgag

SEQ ID NO: 730 - DNA, 1209 bp; single-stranded, linear
  immediate source library: HYPONOB01
  immediate source clone: 381698
aagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttccncagcgacag

SEQ ID NO: 731 - DNA, 256 bp; single-stranded, linear
  immediate source library: THYMNOT02
  immediate source clone: 390371
ggatttccatgtaaaaacggggcgaatgatgtgaaacaccatcggtggttccgctccgtggactggaaagctgttccgcagagaaaactgaagcctcccatcgtgcccacgatagctggcaacggcgacacttccaacttcgaaacttaccctgagcatgactgggacacagccgcgcccgtgccgcagaaggatttagaaatcttcaagaatttctgnggacgagctcacatctggaagaaacaggaagattngt

SEQ ID NO: 732 - DNA, 255 bp; single-stranded, linear
  immediate source library: TMLR2DT01
  immediate source clone: 391609
aattctgcgtctgcttccgtcctnnaggaaatggacgcagtggcccntgaggaantggctgtgaanttcacccagtaggaatgggctttgctgggtccatcacaccaanaaatttatacagatatgtgatgcaagaaaccatcaggaaacctggactgtataagaatgatatgggaagaacagaatactgnnnatcagtacctaggagaaatctaagccacatcagagttgattctggacacaaaccacatgant

SEQ ID NO: 733 - DNA, 276 bp; single-stranded, linear
  immediate source library: TMLR2DT01
  immediate source clone: 393531
atcagagctccaaccttcttgtccatcagagagtccacactggagagaagccctacaaatgcagtgagtgtggcaagtgctttagttcaagctccgttcttcaagtccactggaggtttcacacaggggagaaaccatataggtgtggtgagtgtggaaagggcttcagccaatgtacacaccttcacattcaccagagagtccacacaggggagaaaccatacaaatgcaatgtgtgtggaaaggattttgcgtatagctctgttcttcacactc

SEQ ID NO: 734 - DNA, 278 bp; single-stranded, linear
  immediate source library: TMLR2DT01
  immediate source clone: 393590
cggaggaggaattggggctgctgggccctncccagaggaagctgtaccgagatgtgatggtggagaactttaggaacctnctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatat

SEQ ID NO: 735 - DNA, 293 bp; single-stranded, linear
  immediate source library: TMLR2DT01
  immediate source clone: 394776
gcaacgttctgtatttagtcagtgtggaaaagccttcagcctgaacccagatgttgtttgccagagaacgtgcacaggagagaaagcttttgattgcagtgactntgggaaatccttcattaatcattcacaccttcagggacatttaagagctcacaatggagaaagtntccatgaatggaaggaatgtgggagaggntttattcactccacagaccttgctgtgcgtatacaaactcacaggtcagaaaaaccctacaaatgtaaggaatgtggaaaaggntttagntatt

SEQ ID NO: 736 - DNA, 284 bp; single-stranded, linear
  immediate source library: TMLR2DT01
  immediate source clone: 394838
gaaaagccttcagccggaagtgccggctcaatagacatcagcgatcacatactggagagaaactctatgggtgcagtgtgtgtgggaaagccttttctcagaaggcatacctcactgcacaccagagacttcacacaggagataagccttataaatgcagtgattgtggaagaaccttctattttaagtcagacctgaccagacatcagaggattcatacgggagagaaaccttatgaatgtagtgagtgtgaaaaagcctttagaagcaagtcgaagctcatt

SEQ ID NO: 737 - DNA, 247 bp; single-stranded, linear
  immediate source library: TMLR2DT01
  immediate source clone: 395476
ggtctatgtgggaattnccaaaggacagtgtgagcaagaagaagaagtccttaagaccatccaagatggagattctgacgaactcacaataaagcgatttattgaaggaaaagagaagccaggancactgtggcacatatatgctgcaaaggacanggagaagataagggaatttnttaaaaaggtatcagaagagcaagntcaagaaaacccagcagaccacgntcctnttcatgatcaaagctgt

SEQ ID NO: 738 - DNA, 172 bp; single-stranded, linear
  immediate source library: PITUNOT02
  immediate source clone: 398934
aatgtggcaaggtttttaattgaaaatcaaaccttgaacatcatcatagagttcatatcggagaaaaaccttacaaatgtgaagaatgtgacaaagttttcaatttcaattcacgccttgaaatacataggagagttcatactggngagaaaccatagaaatgtaaggtttg

SEQ ID NO: 739 - DNA, 277 bp; single-stranded, linear
  immediate source library: TMLR3DT01
  immediate source clone: 401269
cttctcaggagcagtcacangaggcagaaaagtgcagaaggaagggaagatcagctatgccgactttgtctggtttttgatctctgaggaagacaaaaaaacancgaccagcatcgagtactggttccgctgcatggacctggacggggacggcgccctgtccatgttcgagctcgagtacttctacgaggagcagtgccgaaggtgggacagcatggccatcgaggccctgcccttccaggactgcctctgccagatgcttgacctggtcaagccg

SEQ ID NO: 740 - DNA, 223 bp; single-stranded, linear
  immediate source library: TMLR3DT01
  immediate source clone: 401429
aattctgaatgtgcccgctgccaggctgtgatgagcaggcctcccaggtggcgctggagaactgttcagcagtggccgacaaccgctgtggctgtaagcaggctggtttgtggagtgccaggtcagccaatgtgtcagcagttcanccttctactgccaaccatgcctagactgcggggccctgcaccggcacanacggctactctgttcccgcagagatact

SEQ ID NO: 741 - DNA, 273 bp; single-stranded, linear
  immediate source library: TMLR3DT01
  immediate source clone: 401777
gggatattngctngaggcttcttgacanatgtggtgacanaaacttgcatggntgaaggccaaattncaactttgtgccgtgagtgtctncaagctctngagttcttgcaatcggancaggncaatcacaggacatcaagagtgacaatattctgtttgggattggattgctctgtcaagctaactgacttttggattctttgcacagataaccccagagcagagcaaacggagcaccattgtanggancccatattgnttgcacccaanggt

SEQ ID NO: 742 - DNA, 259 bp; single-stranded, linear
  immediate source library: TMLR3DT01
  immediate source clone: 402573
acaatttnctataagtgattttattgtagctcaactcttatttatacaacatgtaagtattgttcttatggncaattttcagagatgcatatgtaatttaatttcattttgttttctacanttctctgtagtactatgncaatcagaatggctcaaataccaagggaagtgttattggntctctaatgagatgaaaagctggagtgacagttatgtgtattgtttggaaagaaaatctcatctactaatcatacatgac

SEQ ID NO: 743 - DNA, 254 bp; single-stranded, linear
  immediate source library: TMLR3DT01
  immediate source clone: 402727
gttctncttaaagaagttaggggtaaacaatatctctggtattgaaggaggtgaatatgtttacaaaccaaggnaccagtgatcccctttaacaaccctaaagtcaaggnaattttggcagcggacaattttnaccattacaaggccatgntgagacaaagcagctgacagaaatgctacccagcatttaaaaccagtttgtgcggatagtcttgactagtttaagggggacttggccgagnttttgccccaaa

SEQ ID NO: 744 - DNA, 257 bp; single-stranded, linear
  immediate source library: TMLR3DT01
  immediate source clone: 403002
tgctggtggacgaggagtcacagagggagccaggggccagtggggctccaggccagaaaaagtgctacagctgccccgtgtgctcaagggtcttcgagtacatgtcctaccttcagcgacacaggatcacccactcggaggtaaagcccttcgagtgtgacatctgtgggaaggcattcaagcgcgncagcacttggcacggcaccattccattcacctggcgggtggtgggcggccccacggntgcccgntctgcc

SEQ ID NO: 745 - DNA, 220 bp; single-stranded, linear
  immediate source library: EOSIHET02
  immediate source clone: 407546
ccagtactttttaatgttggaatcaatgaacagcaaactctggctgaaaggtttggagatgtctctttgcaagaaagtattaatcaggaaaacttcgaacttctacaagantattacaagatatttatggaaaagatgcctcctgattatatttcacattttcaggaacaaaatgatttaaaagcattgctagaaaatctccttcaaaatatccaatcca

SEQ ID NO: 746 - DNA, 241 bp; single-stranded, linear
  immediate source library: BRSTNOT01
  immediate source clone: 413718
attcgaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaag

SEQ ID NO: 747 - DNA, 228 bp; single-stranded, linear
  immediate source library: BRSTNOT01
  immediate source clone: 415685
attctttggctgctgtcataacatccagagctttgtcgtatttggcacacagcagaggcccagatattagaaaggctctattccaataaactatgaggactgccttatggatgatttaagtgtctcactaaagcatgaaatgtgaatttttattgttgtacatacggtttaaggtatttaaagtatttncttctctgtgagaaggtttattgttaatacaaggtataa

SEQ ID NO: 748 - DNA, 215 bp; single-stranded, linear
  immediate source library: BRSTNOT01
  immediate source clone: 415908
attcggagatccacaatngagagaaaccttacaaatgtaatgnatgtggcaaggtcttcagtcgcaattcataccttgcccaacatctgtaattcatgccggtgagaaaccttataagtgtgatgaatttgacaaaggcttcagtcaaaattcacacttgtacaacatcacagggtccctacttgagaggaaccttacaaatgtgatgatgtggc

SEQ ID NO: 749 - DNA, 244 bp; single-stranded, linear
  immediate source library: BRSTNOT01
  immediate source clone: 415935
attcgttcaaagctgttggcctctgcaaagggaataccagttcttggcaatcagtgttaccgttcanccattgccgttgagggttcaaagagcctttttctanggctanaagctttgtgaacaagtncctgtaattgttgnttgtatgnataattcaaagcacccaaaataaggaaagtgtagnattatttcaacatatttacagaccgaactgttggtanaaatttaattactgctagnctna

SEQ ID NO: 750 - DNA, 1140 bp; single-stranded, linear
  immediate source library: BRSTNOT01
  immediate source clone: 417398
gctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattagggctcactgggacagaactttcaagttccttcaactgtgaaaagtg

SEQ ID NO: 751 - DNA, 246 bp; single-stranded, linear
  immediate source library: BLADNOT01
  immediate source clone: 426033
ccaccacgactctggtgcacgtgtttgccaatgaaagtgtttctaatgcaactgcgattgactcccagatagctagaagtttgcacatcccactcacccaggntatagctggtgacccaagctatgaaattagcaaacagagactcagtattgtcattggcgtggttgctggcattatgacggtgattctaatcatcttaattgtagtgatggcaaggtactgcaggtccaaaaataaaaatggnt

SEQ ID NO: 752 - DNA, 210 bp; single-stranded, linear
  immediate source library: BLADNOT01
  immediate source clone: 427133
cggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgaccctt

SEQ ID NO: 753 - DNA, 307 bp; single-stranded, linear
  immediate source library: BLADNOT01
  immediate source clone: 428421
ctcgtgccgtgaccatccagtgtgactcacaggtggcatttgatggcttcattctgtgtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcancctgggccctgtgagccgntnctacgggggccagtacanatgcttcggtgcatacaaaccttt

SEQ ID NO: 754 - DNA, 217 bp; single-stranded, linear
  immediate source library: THYRNOT01
  immediate source clone: 435043
accaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggnggaagtctttctgctctccttcgttccaaatggggtccattaaa

SEQ ID NO: 755 - DNA, 233 bp; single-stranded, linear
  immediate source library: THYRNOT01
  immediate source clone: 440242
tatcaccacacgggtacgtgccgagcaccactccccagcagaccaactanaactccgtcaccacgagcatgaacggatacggctctgccgcaatgnccaatnngggcggctcccccaccttcctcaacggctcagctgccaacnccccctatgccagtaagtagagatgcatatccngcgttccngcacgtttcgctagaagaacttggcatcatgccatgtggcccagtggg

SEQ ID NO: 756 - DNA, 1270 bp; single-stranded, linear
  immediate source library: MPHGNOT03
  immediate source clone: 442279
tggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcctgggcctgtacagtgagacayttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcatta

SEQ ID NO: 757 - DNA, 234 bp; single-stranded, linear
  immediate source library: MPHGNOT03
  immediate source clone: 445186
attccaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccaga

SEQ ID NO: 758 - DNA, 235 bp; single-stranded, linear
  immediate source library: MPHGNOT03
  immediate source clone: 446750
attcgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggnnnnnnnnnnnnnnnnnnngaatgccttgaagacagtaccatgggaagtgttgcagacacagtggcaagg

SEQ ID NO: 759 - DNA, 241 bp; single-stranded, linear
  immediate source library: TLYMNOT02
  immediate source clone: 448504
aaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatcta

SEQ ID NO: 760 - DNA, 767 bp; single-stranded, linear
  immediate source library: TLYMNOT02
  immediate source clone: 449555
attanccactcaacnggnccctacctgaaantgatctttattcacaatgtctttacaaaggctcctgcaacacagcagcnatggcaatttggcggacttctgcgctgggccagcgtatagctcttactccacactcaccggcagccttacgatggacgataatagaaggattcaaatgctagcagacacggtggctactctgcctcggggacaaaagcagcttgctttgaccagatcaagttctttaagtgacttttcctggtctcaaagaaagcttgttactgtggagaagcaggataatgaaacatttggatttgaaattcttttttacaggccccagaatcagaatgcctgctcctcggaaatgttcactttgatatgcaaaatacaggaggacagcccanctcactgtgctggccttgcaactggttgatgttccttgcaaatatcaatggtgttgagcacagaaaggttttacctacaaacaattcgttgaacttgatnagatcgtctggaaacctgctaacgatnganactctnaatggaacaatgattctgaaaagaacggaacttgaagcaaagctgcaggttttaaagcaaactttgaaacaaaaatgggtgggantacagatctctgcagttacaggaacatcgtctgcttcatggtgaagcagctaaatgccccanttggaaacatggacttggatnaattgtctttgttttggaccctgctnggccaggccacccttgttgaccggaatcaatat

SEQ ID NO: 761 - DNA, 244 bp; single-stranded, linear
  immediate source library: TLYMNOT02
  immediate source clone: 451192
acgagaaaaggcttcaataatantacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactngggagaagncctatgagt

SEQ ID NO: 762 - DNA, 238 bp; single-stranded, linear
  immediate source library: TLYMNOT02
  immediate source clone: 451538
aggacttcgagctgattcagcgcatcggcagcggcacctacggcgacgtntacaaggcacggaatgttaacactggtgaattagcagcaattaaagtaataaaattggaaccaggtaaattgtttgaaattcatttttcttactgctagaaagccctgggntatcttaaggcttattttaatgatgtttngttaanattctcttgtttttccccacatctgggntaaatagagctgct

SEQ ID NO: 763 - DNA, 791 bp; single-stranded, linear
  immediate source library: TLYMNOT02
  immediate source clone: 453980
tgggggncnttttcttnttggggtcctncnnganttcanggacntgggccccgacccaaaaatcnctcctttttcantanccaacatgcccatcactcggatgcgcatgacaccctggctanagatgcagattaattccaaccaaatcccggggctcatctggattaataaagagganatgatcttccagatcnnatggaagcatgctgccaagcatggctgggacatcaacaaggatgcctgtttgttccggagctgggccattcacacagcccgatacaaagcaggggaaaagganccanatcccaantacgtggaaggccaactttcgctgtgccatgaactccctgccatatttntttgtatgtgaaagaccagagcagggaacaagggcagctcagctgtgcgagtgtaccggatgcttccacctctcaccaagaacctnaganaataaanaaagtctaagtctanncnaanatgnttttatnattgcctnattaagaantcntgtgggggattccnagccctgataccttctctgatggactcagccagcttccactcttgcctgatgaccacagccagctaccccngttccnggctacattgcnggacttggaaggtggaacaggcctgactccanactgtcnccatgttgctgtcagcancctcctccccaactggcncttcccnntggaaatttgtncccgaacancnccnntgaactgttcaacttccaggtttcccccntgccctncactcctgaaacttccnctnaataangaatgang

SEQ ID NO: 764 - DNA, 252 bp; single-stranded, linear
  immediate source library: KERANOT01
  immediate source clone: 455539
gtcggaaggtaccccatncccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatntttgaactcctggactatattgtgaacgagccaccttctaagctgcccaacggtgtgttcaaccccgactttcaggagttt

SEQ ID NO: 765 - DNA, 242 bp; single-stranded, linear
  immediate source library: KERANOT01
  immediate source clone: 456122
atcgcgtggagtgaaggtcacgccgcggcgcgattgacttctaaagagtcatgctgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctc

SEQ ID NO: 766 - DNA, 203 bp; single-stranded, linear
  immediate source library: LATRNOT01
  immediate source clone: 464199
gtgaaagaggatccagccctgagcatcacccaagtgcctgatgcctcaggtgacaganggcaggacgttccatgccgaggctgccccctcacccagaagtntgagcccagcctcaggaggggccaagaaccagggggccatcaaaagcatcgggatttggcattggttccagatgagcttttaaagcaaacatagcagttgtt

SEQ ID NO: 767 - DNA, 222 bp; single-stranded, linear
  immediate source library: MMLR1DT01
  immediate source clone: 472480
gnactacttntntatattcgnaaaatcggttcatttgatgagacctgtacccgnttttacacggctgngattgtgtctgntttagagtacttgnacggcaagggcatnattnacagggaccttaaaccggnaaacattttgttaaatgaagatatgcacatccagatcacagattttggaacagcaaaagtcttatccccagagagcaaacaagncagggcc

SEQ ID NO: 768 - DNA, 511 bp; single-stranded, linear
  immediate source library: MMLR1DT01
  immediate source clone: 472981
ttcccctnattaaagancctcgacagggcccgcacctaaantgctgtgcgtttctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaanactgggagcacgctgccaatgatntttcatttgccaccatccgttttcatgacctcctgtcacagctggatgatcaatatantcgcttttctttnnatnnttntttcttgctacagcataacataaggaaaagcaagcgtaatcttcaggataattttcaggaanacccaatccagatgtctatgatcatttacagctgtctgaaggaagaaaggaaaattctggaaaacgcccananatttaatcaggctcagtcggggaatattcanagcacagtgatgtt

SEQ ID NO: 769 - DNA, 257 bp; single-stranded, linear
  immediate source library: MMLR1DT01
  immediate source clone: 474377
gagcananaagnttctaggacaagagccaggaagaaaccancggnagggaccatttcactgagtgtaaacatggctttcaagctggccgtggctctcttggnagccttcctgntttctgcagctctgtgtgaaggtgcagttttgcaaggagtgctaaaggacttaggtgtcagtgcataaaggccatactccaaacctttccaacccaaatttatcaaaggacttagagtgtttagagttggnccnaattnggnca

SEQ ID NO: 770 - DNA, 274 bp; single-stranded, linear
  immediate source library: MMLR2DT01
  immediate source clone: 475180
ttcattctggttttaaaaagcaaccttcagaagcaagactgggcatctttctacagaacagggnnccgtagtggggctgtttgtgtgttccgggtgacatctggcaatcccccactgcagaggcaattttaagaaaatctgcagataataaaaacgtttcaggtaattggancgttgacagcagagcggncttggactgagaatgtgggctagcccttaaaagcaagagctctaagctnnctaagaaactgtggcattaccaggncatcaaata

SEQ ID NO: 771 - DNA, 247 bp; single-stranded, linear
  immediate source library: MMLR2DT01
  immediate source clone: 476625
aagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaa

SEQ ID NO: 772 - DNA, 2311 bp; single-stranded, linear
  immediate source library: MMLR2DT01
  immediate source clone: 477245
gcggtggtgatggcggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgttcctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagaaaattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgnacaatccttccctcatcccatcacacaactttttttgtgtgtgataaactgattttggtttgcaataaaaccttg

SEQ ID NO: 773 - DNA, 274 bp; single-stranded, linear
  immediate source library: MMLR2DT01
  immediate source clone: 477518
tgaaaatattgtaaaacaaaccttgatggaaaatggaataacacggctgtgtgtattctttggacgtcagaaagccaacgntgttttgttgtcccacatgattactttcctaaatgataagaatgattggcatctacgtggagcattttttgatagtatagttggtgttgctgcctatgttggctggcaaagctcctcaattctcaagcctctgctgcaacaaggtcttagtgatgctgaggaatttgtcattgtgaaagctctttatgccctt

SEQ ID NO: 774 - DNA, 893 bp; single-stranded, linear
  immediate source library: MMLR2DT01
  immediate source clone: 478682
tgncattcataggncccattctnaaaagnagataganttttaaaaataagtgtaaatgcaatggaacaagaaggantgcttatgacaaaggtagactaagaatagttactgcaaaggggctaaatttaactctggtaatctgtacagttaanactaaaaggaaaacaggccctgtgactttaanaatattcacttaacccccctgatcttagttcccctatttgtaaaggcaganagtgatagtacctaccttgcagggttgtaaggagcaaacnataatgtatgtaaggtgcttaatgactcctgacatttggtaanctctccataaatagcagctattattaattaccgtaaaagttctggaggtaggcccaggggaaaaggggctgagtatcagtgctgactgtaagggatcacagattcgatatgtctactatagtgggacatttgtttgttttacagtgggcctgttctatagcatctttacagaccagttgaaatgcaaccttattgtgatcaatctaaatcctganatcaacctgaaggatctgcatcctcctgganttcatgttcacatctcggctcaatttgcgggaaggccacatcatngcttgtnatggccacggctatgttnctgccnaatggaacatttttgttgacacttgccngaaatttattaanggccatgaaaccaaaattgtttctgccatccaacctcccgtgaanattnctccacaaccggatgctgaatccccaaaaatcatggcctatcngggtcttaaagtgttggaaaacaactgccctgaagaacccccnggttttaaaacaaaccttgnccccaccctttanatggctntcccnccccacccctttcntttcagccnctcccttcn

SEQ ID NO: 775 - DNA, 1541 bp; single-stranded, linear
  immediate source library: MMLR2DT01
  immediate source clone: 478861
gaacaagatggattatcaagtgtcaagtccaatctatgacatcaattattatatatcggagccctgccaaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttcatacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagagtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaacgacacttttcatgtgtga

SEQ ID NO: 776 - DNA, 240 bp; single-stranded, linear
  immediate source library: LIVRBCT01
  immediate source clone: 480457
ggaaggggcttctcatccactgccaggctggggtgtcccgctccgncaccatcgtcatcgcttacttgatgaagcacantcggatgaccatgactgatgcttataaatttgtcaaaggcaaacgaccaattatctncccaaaccttaacttcatggggcagttgctagagttcgaggaagacctaaacaacggtgtgacaacgagaattcttacaacaaagctgatgggcgtggagacgg

SEQ ID NO: 777 - DNA, 226 bp; single-stranded, linear
  immediate source library: LIVRBCT01
  immediate source clone: 480959
ctgcaatacatgtaaatttgctaccatcacatgtaatctcacttcttctgacatcagccaagtcaatgtttcgnttatcttgtggaaaccaacttttataaaatcatatttttccagcttaaatcttactataaggggagnanttcggagtgaaaanncatctctgggnttaagngcagcaaatnaaaaaaagngggtntttttnaaaanccnaagnggggtnccg

SEQ ID NO: 778 - DNA, 216 bp; single-stranded, linear
  immediate source library: HNT2RAT01
  immediate source clone: 482881
aggagcccagcggccgnnggccatttctccngggttaanggggggncccnnaaaaatttttggggagatcaaaattgagggttgngtngagaggatcaaggtctctcaggcagctgcagagcttcaanagtantgtatgcagaatgcctgcaaggatgccctgctggtgggtgttccagctggaagtaanccnttncgggagcctagatnctgtgc

SEQ ID NO: 779 - DNA, 241 bp; single-stranded, linear
  immediate source library: HNT2RAT01
  immediate source clone: 485081
agaagattgaggagttcgcggagatggtggagcnggaggaagaggacgacgngctggacagcgagggccgcgacagcgaggngcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgccca

SEQ ID NO: 780 - DNA, 235 bp; single-stranded, linear
  immediate source library: HNT2RAT01
  immediate source clone: 485164
tagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaa

SEQ ID NO: 781 - DNA, 232 bp; single-stranded, linear
  immediate source library: HNT2RAT01
  immediate source clone: 485985
ctcttactttgcctccgcagtatacacgtacatccaaagccggttctaccgatccccagaagtgatcctgggccanccctangangtggccattgacatgtggagcctgggntgcatcanggcggagttgtacaagggntancccctgttccccggggagaatnaggtggagcagntnggctncatcatggagatttcaaaggttttctaaaaatataaccaacaacagggg

SEQ ID NO: 782 - DNA, 764 bp; single-stranded, linear
  immediate source library: HNT2RAT01
  immediate source clone: 486596
anngccggttancttcacggccctgtgtccactgctccnagangcccagcctctggtcctgtgacctgctagctatcacggatgggctccccgggtattgggaatccacagctaagacgccgggacaccctggaagcctagaaatggacaacctgaggtatggagtgtatcctgtcaagggggcaagtggataccctggggctganaggaatcttctggagtactcttattttgaaaaggggccgttgacatttagggatgtggtcatagaattctctcaggaggagtggcaatgcctggacactgctcagcaagatttgtataggaaagtgatgttagagaacttcagaaacctggtgttcttgggtattgatgtctctaagccagatctgatcacctgtctggagcaaggaaaagatccctggaatatgaaganacacagtatggtngccacacccccagaaagtggggtattgaaatttcctactataattatattgctgtctangtgtttcctccagtctgtcaatatttgctttatatatttggaancttattgttgacatacccccgacncncagaagttcacacacacncacacacncacaaaatttgttcatagttccccntttaataaatctattattgtttaatgttcnaaaaaaaaaaaaaaaaaaaaaaaaaaangggggnggcccttnnaaaaacccncgggggggccantttnnntttttaaaaaaatttttcncccccaantttttaan

SEQ ID NO: 783 - DNA, 244 bp; single-stranded, linear
  immediate source library: HNT2AGT01
  immediate source clone: 487363
ggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttnaacaactcccctggagaacacatccattaaagtggggccagctcggaagggcagctacaaggccaagatggcccgaaggagcaagaggagccgcggcaaggat

SEQ ID NO: 784 - DNA, 271 bp; single-stranded, linear
  immediate source library: HNT2AGT01
  immediate source clone: 487794
ctttgacaatatcctgtttgccatcttgacggtgttccagtgcatcaccatggagggctggactgacatcctctataatgtgagtggcgtcttggccctgggctgagggcaggccctggacctcctgagctggtgcctctgggggtccatttaggggggcccttctgacctcagagcctntgcccagccctaggntcctccctgcacccctaggatgaaatgcaggntctttccggcaganggcccacccaagggtccaacacaggcagcc

SEQ ID NO: 785 - DNA, 244 bp; single-stranded, linear
  immediate source library: HNT2AGT01
  immediate source clone: 488190
cagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctg

SEQ ID NO: 786 - DNA, 253 bp; single-stranded, linear
  immediate source library: HNT2AGT01
  immediate source clone: 488722
attgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggntacaactnaccccaggagtatattgccacccaggggccactgcctgaaaccagaaatgacttctggaagatggtcctgcaacaaaagtct

SEQ ID NO: 787 - DNA, 627 bp; single-stranded, linear
  immediate source library: HNT2AGT01
  immediate source clone: 490234
tangnaaatggncggatgtggacccaccgggcaatggtccagcgttcaaccgggtagggggcaggggcagggggcactgtgacnggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggaattttgtgacaggctctgttagtctgttcctcccttatttgaaggacangntaaanatcnnttttggaaatgagagaggactagcatgacacattggctccaccattgatatctcccagangtacagaaacaggattcatgaagatgttgacaagactgcaagttcttaccttanctttgttttcaaagggatttttactctctttaggggaccataactttctaaggagagagattaaaatagaagtgaccttgttttanggggcctgtttcctattaacnaaaaagcactgggaactgaagaatgtgggcgaatcaatgaataacgaaggaatcaccaannn

SEQ ID NO: 788 - DNA, 882 bp; single-stranded, linear
  immediate source library: HNT2AGT01
  immediate source clone: 490256
cttcttccgtcnggaaagacgnncctgggcccctgttcaaccctncgcgttttatagaggataaatctcctggcaaagcccacaatgaccccagccctggaaacctgaggaccaaaaaggacttctgataattaaggcagaggaccattactggggacaggattccanctcncaaaagtgcagtcctcacatgagggaactctatatacaacacttcaggaagctctgctatcaggatgcacctggaccccgtgaagctcttacccagctgtgggagctctgccgtcagtggctgaggccagaatgccacaccaaggagcagattttttntnttctngtgttagagcagttcctgagcattcttcctaaagacctgcaagtcntgggtgcgtgcacaccatccananactgganaggaggcagttgacggttctgggaggatctggananagagcttgatgancctggaaagctggtcncaggcanttcccaaagacggggacttnctcttgggacaatttggccccctttgggatngccatttgattcactgantgtcnancnccatcncaaatagacccanctgganccggatgctgggancccccaaggaatggtgaatnatcttggtccccaattaaaaattnttccaaanggaaaatttgcccnaanacaaggntttcctttggggaanttanttgaccnactgaacnaanattcnctcgcctccnaattccaaatttttgaaaatgaggncnatcnaatntcccnnaaggggaaaaaaanaaattnttttttanntgngaaaaattttccntcctncccaaactttttaaccnganaatccccnggaaaaaancccttaatnttntatttttgaaa

SEQ ID NO: 789 - DNA, 570 bp; single-stranded, linear
  immediate source library: HNT2AGT01
  immediate source clone: 490609
ctcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccgtgctgaggctgccagaccccgaccctgaggggctgctcctgggggccaccgcaggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgrgtggcctctccaagccctggtggtgctrrgggttgtatccccggccacctcctgtccaggtctccatccccctttggatgggaggcctctctgttacagccctccccatgctgtgccctgccatatacgtgggggactcagggtcc

SEQ ID NO: 790 - DNA, 248 bp; single-stranded, linear
  immediate source library: HNT2AGT01
  immediate source clone: 491152
ttcattgccgtctctgtcatcgcgaatgtggtggaaacagtgccgtgcggatcaagcccaggtcacattaaagaactgccctgtggagagcggtatgctgtggccttcttctgcttggacacggcctgcgtcatgatcttcacagttgagtatttgcttcgcctggctgcagcgcctagtcgttaccgttttgtgcgtagtgtcatgagtatcatcgacgtggtggccatcctgccttattacattgg

SEQ ID NO: 791 - DNA, 247 bp; single-stranded, linear
  immediate source library: HNT2AGT01
  immediate source clone: 491271
ccgtaatacagatctgcatattcatttcagagttcacacgggagagaaaccctataaatgtaaggngtgtggtaagggcttcagtcaggcttcaaatcttcaagtccatcagaatgtccacactggggagaaacgattcaagtgtgaaacgtgtnggaagggcttcagtcagtcctcaaagcttcaaacccatcagcgagtccacactggagagaaaccatatagatgtgatgtgtgtggtaaggac

SEQ ID NO: 792 - DNA, 315 bp; single-stranded, linear
  immediate source library: HNT2AGT01
  immediate source clone: 491446
gggacttgagcatgagctcaatcaaagtcgatggcattcggatgtccttccagaatcttctggcgaagatctgttttcaccaccatttttccgttgtggagcgagtggactnctgcgnctccatgtacagccgctccatccagggccaccatgtctgcctcctggtgaaaaagggtgagaactctgtctcagtcgacgggaagtgcagtgactccacggtactgagcaacttgttagaagagatgaaggcgacgctggccaagtgttgagagcttcctgcgagnccccgcaccaccccgcggagcacgtaaccca

SEQ ID NO: 793 - DNA, 220 bp; single-stranded, linear
  immediate source library: HNT2NOT01
  immediate source clone: 492611
cggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccaccatctgcaagtactaccagaagggctactgtgcctatggaactcggtgcagatatgaccacangaggccctctgctgcagc

SEQ ID NO: 794 - DNA, 226 bp; single-stranded, linear
  immediate source library: HNT2NOT01
  immediate source clone: 493684
tgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacc

SEQ ID NO: 795 - DNA, 223 bp; single-stranded, linear
  immediate source library: TMLR3DT01
  immediate source clone: 506361
ctctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtgg

SEQ ID NO: 796 - DNA, 232 bp; single-stranded, linear
  immediate source library: TMLR3DT01
  immediate source clone: 507537
gacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaa

SEQ ID NO: 797 - DNA, 218 bp; single-stranded, linear
  immediate source library: TMLR3DT01
  immediate source clone: 509215
ctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcc

SEQ ID NO: 798 - DNA, 246 bp; single-stranded, linear
  immediate source library: MPHGNOT03
  immediate source clone: 511091
gcacagtggggaaaaacctttcaaatgtgaagagtgtgggaaaagatttactcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctgaagtgcaagt

SEQ ID NO: 799 - DNA, 293 bp; single-stranded, linear
  immediate source library: MPHGNOT03
  immediate source clone: 511655
aaaacctacacaaagagttcccatctcaaggcacacctgcgaacccacacaggtgagaaaccttaccactgtgactgggacggctgtggatggaaattcgcccgctcagatgaactgaccaggnactaccgtaaacacacggggcaacgccgttccagtgccaaaaatgcgaccgagcattttccaggtcggaccaacttggcttacacatgaagaggcatttttaaatnccagacagtgggtatgacccacactgccagaagagnttcagtattttttanttttcacaatgg

SEQ ID NO: 800 - DNA, 970 bp; single-stranded, linear
  immediate source library: MPHGNOT03
  immediate source clone: 513418
gaagtgtaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcatgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaaaaaagaatgatatgtgagaagatggccaatccagtgcagttggttctacatattttagggaggcatgaggcatcaatcaaatacatttaaggagtgtaggg

SEQ ID NO: 801 - DNA, 889 bp; single-stranded, linear
  immediate source library: MMLR1DT01
  immediate source clone: 514710
ggcttgagtancgtgggctttnngcccacncgggaaagatatcagaatcatcctaggatcaggacgttcccgatggtccttctttggctcacgctgctcctgatcgccctgccctgtctcctgcaaacgaaggaagatccaaacccaccaatcacgaacctaaggatgaaagcaaaggctcagcagttgacctgggaccttaacagaaatgtgaccgatatcgagtgtgttaaagacgccgactattctatgccggcagtgaacaatagctattgccagtttggaacaatttccttatgtgaagtgaccaactacaccgtccgagtggccaacccaccattctccacgtggatcctcttccctgggaacagtgggaagccttgggcaggttgcggagaatctgacctgctggattccatgacttggaatttccttgaagcttgcagcttgggcnggtaagncccggggggncccccgccggaantttccaatttcgaactttgttactttgaacgtttgccaacnaggcgtcnacagttacgaatgtcttcacttacnaaacggatgctcnagggaacacattatcnggtgtcgttncnataaantctctcaactctccangggttctcaatnttcccacttcctggtgcggggcaggaacccnccttcggttccctgcacaaatttttttctctttccaattgaaatntactcccccncntgatgcaaattttntaaaaacttccnttatgcctggaaatnaaatcnttcatccnattccnatgactccnatcaaaaaaatgcccnntncccnaacnnncaaaaaaaccctcccgntancatctggaanttccnttcaataaaaccggaaanattttaatctgaccct

SEQ ID NO: 802 - DNA, 243 bp; single-stranded, linear
  immediate source library: MMLR1DT01
  immediate source clone: 515253
ggccttagcgcggctnagccatgagcaacaggagtagcttttnccggctnaactggtgggtatnantgtgccgagcgctnttggctttnggggaacctagaagtgtggaaacctaacggaatctgtgtctctaaggttcaaggagcagaggaaagctttggtcaacaccagcgacaaggaggttcccaacggaattttngaggagcaagagcancaaagggtgatgctnctnaacaagtcaac

SEQ ID NO: 803 - DNA, 228 bp; single-stranded, linear
  immediate source library: MMLR1DT01
  immediate source clone: 515399
ggaggggctgccagactccgggagctgctgcctggctgggattcctacanaatgcgttgcctggctccaagncctgctgggtcctacctgtcagagccccaaggcagctcanagtgtgccancatggagttggggcccctagaaggtggctactggagcttcttaacagcgatgctgaccccctgtgcctttaccanttntatgaccagatggacctggntggagaag

SEQ ID NO: 804 - DNA, 990 bp; single-stranded, linear
  immediate source library: MMLR1DT01
  immediate source clone: 515847
cacagacagtcatctcaggggcagaaagaaaagagctcccaaatgctatatctattcaggggctctcaagaacaatggaatatcatcctgatttagaaaatttggatgaagatggatatactcaattacatttcgactctcaaagcaataccaggatagctgttgtttcagagaaaggatcgtgtgctgcatctcctccttggcgcctcattgctgtaattttgggaatcctatgcttggtaatactggtggtagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaaggggaagggtggaagaaggagagaranaatatgtgaggtaktaaggaggacagaaaancagaacmgaaaagaktwacagctgaaggtcaagataaatgcagaaaantgtttararagcttkgccaactgtwatcttaaccmarraattgaagggagargctgtgatttctgtatttgtcggcnactacaggtaggctagtattatttttctagttagtaaancccaaanatggatcagggcnccaacngnatttaattttaatattattttnngaaanaggtcccctttgttcccaggtgaatncatncc

SEQ ID NO: 805 - DNA, 525 bp; single-stranded, linear
  immediate source library: MMLR1DT01
  immediate source clone: 516219
ccnttttanaggcaaangacagtccccccangtgcttggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcantaaaatgctaaatcatgaaaatgtantaaaattctatggtcacaggagagaaggcaatatccaatatttatttctggagtactgtagtggaggagagctttttgacagaatagagccagacataggcatgcctgaaccagatgctcnnagattcttccatcaactcatggcaggggtggtttntctgcatggtattggaataactcacggggatnttaaaccagaaaatcttctgttggatgaaagggataacctcaaaatctcagactttggcttggcaacngtatttcggtataatnnggg

SEQ ID NO: 806 - DNA, 259 bp; single-stranded, linear
  immediate source library: MMLR2DT01
  immediate source clone: 522433
gccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgngcagatcaagacgagcctgcaccggctgaagcccgacacggtgccagcgccctgctgcgtgcccgacagctacaatcccatggtgctnattcaaaagaccgacancggggtgtcgntncagancta

SEQ ID NO: 807 - DNA, 908 bp; single-stranded, linear
  immediate source library: MMLR2DT01
  immediate source clone: 523374
ttcntttcnacatgccgaggacnggggcccccctgcananaggagctctggagactcagagatggttgctcttcttactgctctgtcnccgggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttnnntncacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgagagaagatttggtactaatatttctcaagtgaatagttttgtgaaccttcgggaaactacacccgtccaccccctgttagggaggcatcatgactgttctgtgtgtggaaagacttcacttgtaactcccaccttgttagacncctgaggactccncngganaagaaaccctataatntntgaatgttggaaaagttacncacnaagctcactcttgccnggcncnaaaggtcccaagaatgaacgcnccttacaaatntccctaaaccggaagaattggaagaaactccctgtgaccaggtganaaactcctcntgganaacctataaatttatgatgcgaaacctccgtggattccaactgtcgactcnaggacctntggaaattgtgcaaactccccnaaattgtttacnccccna

SEQ ID NO: 808 - DNA, 249 bp; single-stranded, linear
  immediate source library: BRAINOT03
  immediate source clone: 529450
tttcagcctncagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttg

SEQ ID NO: 809 - DNA, 236 bp; single-stranded, linear
  immediate source library: BRAINOT03
  immediate source clone: 531037
gtgttcgaactggtcaaccaagggcccgtggatggaagtgcccacccttnaaaccactctctgaagaccaggnccgtttctacttccagggatctgatcaaaggnatcgagtacttacactaccagaagatcatccaccgtgacatcaaacctttcaacctgctggtcggagaagatgggcacatcaagatcgctgactttggtgtgagcaatgaattcaagggcagtgacgcgct

SEQ ID NO: 810 - DNA, 232 bp; single-stranded, linear
  immediate source library: BRAINOT03
  immediate source clone: 531038
cagttctggagctattgcagcctcggttgcccggccgggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttngacagatcctaaagaagataatagagactaaa

SEQ ID NO: 811 - DNA, 266 bp; single-stranded, linear
  immediate source library: BRAINOT03
  immediate source clone: 531418
agcaagtaaaaataggagactttggtctggcctgcacagacatcctacagaagaacacagactggaccaacagaaacgggaagagaacaccaacacatacgtccagagtgggtacttgtctgtacgnttcacccgaacagttggaaggatctgagtatgatgccaagtcagatatgtacagcttgggtgtggtcctgctagagctctttcagccgtttggaacagaaatggagcgagcagaagttctaacaggtttaagaactggg

SEQ ID NO: 812 - DNA, 250 bp; single-stranded, linear
  immediate source library: BRAINOT03
  immediate source clone: 534110
gtcccccgcgctgcaccccagcatntcggaggaggagcgcaagtacatcgaggacgccatcggagagagcgcgaaactcatgaaccccctcacgaagtttagcactccctggcggcgnttcttcacgtctatgccagtctatgccatcatcgtggccaacttctgccgcagctggacgttctacctgctgctcatctcccagcccgnctacttcgaagaagtgttcggcttcgagatcagcaaggtaggc

SEQ ID NO: 813 - DNA, 241 bp; single-stranded, linear
  immediate source library: LVENNOT02
  immediate source clone: 534380
gcttcaccgacgacaacttctgcgaggcctncaagtccaccgtgggtgttgacttcaaaatcaaaactttagagctaagaggaaagaaaattagattacagatctnggacanagcaggtcaggagagattcaacagcattacctcagcttattacagaagtgccaaggggtcatattagttatggtatcacttaggngggggnatttnntgnttnccgaatggttgaggtgtttataagtt

SEQ ID NO: 814 - DNA, 229 bp; single-stranded, linear
  immediate source library: LVENNOT02
  immediate source clone: 535129
agaacgncgacgtccggccccccttcanctacggcttcctcatccgncaggncatnctggaaacccctgacaggcagctgaccctgaatgagatctataactggttcaccagggtgttcggctattttcgcagaaacantgccacctgggagaacggcgtgcgncacaacctnagcctncacaagtgcttngtccgcgtggagaacgttaagggtgccgtgtggacttt

SEQ ID NO: 815 - DNA, 180 bp; single-stranded, linear
  immediate source library: ADRENOT03
  immediate source clone: 535503
gtgctttgggtatacaaggttatgtgtgtatgcatgtatttcccagcgagcatcatcactttcatgtgtaatgtaacgttctccaatgcgagtttcaaattctctaaggtcaagccaagtctgatagtcctaggagaaaatgaaattgtaatgatgaaacaaaagaaacaaaatactgtc

SEQ ID NO: 816 - DNA, 129 bp; single-stranded, linear
  immediate source library: LNODNOT02
  immediate source clone: 537221
gagnaagacananaggggagaaaccttttggatgtatgaatgtgggaaaaccttccatcagaagttggccctaattgttcaccagagaactcatataagacagaaaccctatggatgtaatgaatgtgg

SEQ ID NO: 817 - DNA, 201 bp; single-stranded, linear
  immediate source library: LNODNOT02
  immediate source clone: 539564
gtggggtgctctggtctgaccgatgtgtctcccagaactattctgggggcccgacaggtgggcctggnaggaagatgttnacatttttaanngtacactggtatttatatttcaaacattttgtatcaaggaaacgttttgtatagttatatgtacagtttattgatattcaataaagcagttaatttatatattaaaaaa

SEQ ID NO: 818 - DNA, 584 bp; single-stranded, linear
  immediate source library: LNODNOT02
  immediate source clone: 539754
tcaaaatttgaggccgaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataagtttggaaaacttctatgaaccatcattaattctcaccaacaggagagaaaccattttggagaggaactgtttgactttaaccaatgtgaaaaagccttgagtgaacactcatgccttaagactcacaggagaacttactttagaaagaaaacctgtgagtgtaatcnatgttgaaaaagccttcagaaaaccctctatctttactttacacaagaaaactgatatcgganaaggaacttcctaactgtatcnatgtgaaacagccttccagccaacatctactc

SEQ ID NO: 819 - DNA, 229 bp; single-stranded, linear
  immediate source library: OVARNOT02
  immediate source clone: 543748
ctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtg

SEQ ID NO: 820 - DNA, 907 bp; single-stranded, linear
  immediate source library: OVARNOT02
  immediate source clone: 543989
gagctgtccataaaaaatttcccacatttgctgcatttgtaagttctttccctagtgtgaactttttggtgccgaatgaggtgggaatttkggctaaaaactctcccacactcagtgcactcaaaagacctttctccaaagtgatwtctccgatgtctaatatgatttgagttgtgcctaaagaatttcccacattcactacactcataaggcctttcaccagtgtgaattctctgatgtgtatcaagtgtggagcgacatctaagggatttcccacaaatgctgcattcaaaaggtctttctccagtgtgaactctctgatgactcttcagtgtacagctgtccacaaagaatttgccacattcnntgntttcataaggcctctctccagagtgaactctctgatgtctattcagtgttgaagcaataccctaaaaagaatttcccacatttgttggcattcataaaggntttttctcccagtatgnaactctcctgaattgaaataatgaattgttggaaantgtcccataaaagaaacttcccacatttcactacactcataanggcttttctccagtgttgaaacttttctgatgttctaatgaattgttggaacgggtatctaaaagaatttccccacattcngttgcattncataaggtttttctcccanttatgaactctcngggtgaataaatgaattgttgcagctggttccataaaanaattccccncattcccaagcaaatnaaaaaaggcctttcctcccagttgttgaaatttctgaagttcnaatgaattcnggaactgttnntaaantttttccccanattccnttggctccataaggcgtccccattttnaatttctnggtnacaacaaggtgaaccnttttaggaaggcc

SEQ ID NO: 821 - DNA, 501 bp; single-stranded, linear
  immediate source library: BEPINOT01
  immediate source clone: 547319
cgcactcgggcgcggagggagcggcggcaggctctcgctttctgcaccatgggctgcacgctgagcgccgaggacaaggcggcggtggagcggagtaagatgatcgaccgcaacctccgtgaggacggcgagaaggcggcgcgcgaggtcaagctgctgctgctcggtgctggtgaatctggtaaaagtacaattgtgaagcanatgaaaattatccatgaagctggttattcagaataggantgtaaacaatacaaagcagtggtctacagtaacaccatccagtcaattattgctatcattagggctatggggaggttgaanatagactttggtgactcagcccgggcggatgatgcacgccaactctttgtgctagctggagctgctgaagaaggctttatgactgctgaacttgctggagttataaagagattgtggaaagatantggtgtacaagcctgtttcaacagatcccgagggttaccagcttaatgattc

SEQ ID NO: 822 - DNA, 244 bp; single-stranded, linear
  immediate source library: BEPINOT01
  immediate source clone: 548019
agacattaataagcttgaagagcagaatccagatattgtttcagaaaaaaaaccagcaactgaagtggaccccacanattttgaaaagcgnttcctaaagaggatccgtgacttgggagagggccactttgggaaggttgagctctgcaggtatgaccccgaagggaccaatacaggggagcaggtggctgttaaatctctgaagcctgagagtggaggtaaccacatagctgatctgaaaaag

SEQ ID NO: 823 - DNA, 233 bp; single-stranded, linear
  immediate source library: BEPINOT01
  immediate source clone: 548607
aaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggtta

SEQ ID NO: 824 - DNA, 316 bp; single-stranded, linear
  immediate source library: BEPINOT01
  immediate source clone: 548950
attttttcctcagttcaagatagagaagaattatgaaatgaaacaatatttgagagccctagggctgaaagatatctttgatgaatccaaagcagatctctctgggnttgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggtgacatcatcttattcagtggcaaagtttcttgcc

SEQ ID NO: 825 - DNA, 547 bp; single-stranded, linear
  immediate source library: SCORNOT01
  immediate source clone: 552800
nncnggccatctgcggctctcccttcacagtggngggcntgnagncagtcatgggncctcagggngccaggngncacgctttcttggcatttggggntgtcactgtggatttcacccagaaggaatggaggctgctgagccctgctcagagggccctgtacngggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagangaaagaaaaaagcactaagcccatggcattttccagcccacccctaagncatgcagtaagctcaaggnagnagnacagtgtantggaaatagaatctagtcaaggccagaaggaaaatcctacagaaatan

SEQ ID NO: 826 - DNA, 889 bp; single-stranded, linear
  immediate source library: SCORNOT01
  immediate source clone: 553106
tgcnntcntccgnnaaagccagtaacccggcccnttgtgnaagatgangattancaaccatgagccagagcccgggtgcaggctcaccgcccccgctgccaccgcggtcagctccagttcctgccaggagttgtcggtgcgaggaattttgtgacaggctctgttagtctgttcctcccttatttgaaggacaggccaaagatccagtttggaaatgagagaggactancatgacacattggctccaccattgatatctcccagaggtncagaaacaggattcatgaagatgttgacaagactgcaagttcttaccttagctttgtttttttttggatttnnaccctctttaggagaccataactttctaaggagagagattaaaatagaaggtgaccttgttttagggggcctgtttcctattaacgaaaaaggcnctggaactgaagaatgtgggcgaatcaatgaagaccgagggattcnacgcctgggaagccntgttgtttgctattgatgaaatcaacaaagatgattacttgctaccangaatnaagttgggtgttcacattttggatacatgttcaagggatacctatgcattggagcaatcactggantttgtcagggcatctttgaaaaaatttgatgaagctgaatttatttttcctgatggacctatgccattccaagaaaacntcccacttctcattgcagggtcattggttggtccttatacaatgtttccatacaggttggcaaactgctgcggtcttccaaatcctcanatcanctaccctcccccaacgccaaatcantgatantccnctttgaatactttgcaggacgtgccccgantctaccagccaaccatgctgaatcttgccctctn

SEQ ID NO: 827 - DNA, 230 bp; single-stranded, linear
  immediate source library: SCORNOT01
  immediate source clone: 553217
aaaccatacaaatgtaaggtttgtgacaaggcttttgcgtgtcattcctatctggcaaaacatactaggaattcatagtggagagaaaccttacaagtgtaatgagtgcagcaaggccttccgtctgaggtcataccttgcaanccatcgcagggttcatagtggtgaggaaccttacaagtgtaatgagtgcagcaaggccttcantcagggtcataccttcattgccc

SEQ ID NO: 828 - DNA, 225 bp; single-stranded, linear
  immediate source library: SCORNOT01
  immediate source clone: 554215
agcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggca

SEQ ID NO: 829 - DNA, 577 bp; single-stranded, linear
  immediate source library: SCORNOT01
  immediate source clone: 555188
gancgcccctttagtnaggaagatggaccnctggtccagctccgcgcaggggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcanactacaccttccctttgcaggggaactctttcttcgtgatgacaaactttctcaaaacagaaggccaagagcagcggttgtgtcccgagttatcccaccccgcaggacgctctgttcctctgaccgaggttgtaaaaagggatggatggacccgccngagcaaaggaattcagaccanaagtgtgtatgtatgaagggaaccagaaaactgttaattcccncgccggngaaaaana

SEQ ID NO: 830 - DNA, 244 bp; single-stranded, linear
  immediate source library: SCORNOT01
  immediate source clone: 555552
aacagaccagcatagttctgcaataacagttttaaggtgggcatagggtttngaagaaagggagaaggattcttttttcaatgtactgtattgggacgctggtaattgttaacccagtgttcagcnnnnnnnnnnnnnnnnnnnnnnnnnnnnnnnnnnnnnattttcatataatttgccagacagngatcagattgaaccgtcaatgtgaaataaagngttcttcttgtacttgaataataac

SEQ ID NO: 831 - DNA, 1750 bp; single-stranded, linear
  immediate source library: SCORNOT01
  immediate source clone: 555697
tcgacccacgcgtccggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtccgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtttccactccacaagcactcagggttccccagcagctcctgtgtgttgtgtgcaggatttgtttgcccactcggcccaggaggtcagcagtctgttcttggctgggtcaactttgcttttcccgcaacctggggttgtcgggggagcgctggcccgacgcagtggcactgctgtggctttcagggctggagctggctttgttcagaagcctcctgtctccagctctttacaggacaggcccagtcctttgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttctta

SEQ ID NO: 832 - DNA, 245 bp; single-stranded, linear
  immediate source library: MPHGLPT02
  immediate source clone: 557918
cagagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatg

SEQ ID NO: 833 - DNA, 731 bp; single-stranded, linear
  immediate source library: MPHGLPT02
  immediate source clone: 559803
tttnagagtccgcgactncnctgcataaaaaaagtnncaactgataaagatcccaaggnaagaaaaagaggaagaagacgattctgccctccctcaggnaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctncaaacccccacttagaaagggaaacccccaaagcccacgggagaaaaatccnnggaagggttanagaaagaagaagggagaaagaaaggaaaatttaaagttggaanttnaaggtggnaggtggaaagaaaaaagggaaaatnnaatttnanaanggntaagggaccccccccgggganagaaggggnaaaanccnaangnttttccntttncccctttttccccnaaaggggaaaaaaaancccccccccccnttttttcccctttttnaaanagaanggttnttgaacntnccccccccccccccccctttttngccccccccttttaanccccccttttgncn

SEQ ID NO: 834 - DNA, 643 bp; single-stranded, linear
  immediate source library: NEUTLPT01
  immediate source clone: 565623
aanttattcccgcttncancacatcnntntggggggganncacttgcctggagctgcgccacatcccaccggcccttacactgtggtgtccagcagcatccggcttcatggggggacttgaaccctgcagcaggctcctgctcctgcctctcctgctggctgtctccgtcccntccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcgacccggaaacagcgtatcactgagaccgagtcgccttatcaggagctccagggtcagaggtcggatgtctacagcgacctcaacacacagaggccgtattgcccgaatcatgacagtcagcaacatgatacctggatccagccattcctgaagccaccctgcacctcattccaactcctaccgcgatacagacccacagagtgccatccctgagagaccagaccgctccccaatactctcctaaaataaacatgaagcacaaaaaaaaganaaaaaaaaaaaangggcggccctttannggttccaagntta

SEQ ID NO: 835 - DNA, 291 bp; single-stranded, linear
  immediate source library: MMLR3DT01
  immediate source clone: 566670
gatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgcc

SEQ ID NO: 836 - DNA, 265 bp; single-stranded, linear
  immediate source library: MMLR3DT01
  immediate source clone: 568080
gagaagaaacttttgaaatgtaatgactgtgaaaaagtcttcagccagagttcatcccttactcttcatcaaagaattcatactggagagaaaccctataaatgtatagagtgtggaaaagccttcagccagagatcaaatcttgttcaacatcagaggattcatactggagaaaaaccctatgaatgtaaggaatgtaggaaagccttcagtcagaatgcacacctagttcaacatctgcgagttcatactggagaaaaacctt

SEQ ID NO: 837 - DNA, 798 bp; single-stranded, linear
  immediate source library: MMLR3DT01
  immediate source clone: 568987
gccatctgcgaacgtatganngccgctttaagaggacccagagangagngtatcctcnnaaaggtgacnctggaagcaatgaacaccacagtgatncaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacactcatgcttcctttcaaaatcctctctgactcacacctggcaccctggcagctcanagcttttgtgtgtcgtttttcttcggtgatattttatgagaccatgtatgtgggcatcgtgctgttagggctcatagcctttgacagattcctcaagatcatcagacctttgagaaatatttttccaaaaaaacctgtttttgcaaaaacggtctcaatcttcatctggttctttttgttcttcatctccctgccaattatgatcttgagcaacaaggaagcaaccccatcgtctgtgaaaaagtgngcttccttnaangggccnctngggctgaaatggcatcnaatggtaaataacattngcnattnatttcntggantgttttaancctaatgcctgggtttatgtggttantggcnaaaangttttaatccttatnaaantccaaatgtaaggacagaaaaacaacaaaactggaagnaaagtatttctggtcnccccncttta

SEQ ID NO: 838 - DNA, 281 bp; single-stranded, linear
  immediate source library: MMLR3DT01
  immediate source clone: 569038
ggtttctctcccctatggattttgctaatggttgagtgatacctaaaggccttgttgcattttttacacttggggtttctcttcggtttgaattctctcatggttaccaaaactctgttaaaggacttttcacagtcgttaaatgtgtatggctctttcccaatatgaatttttttgatgttaactaggcttttagacttagttaaagaccngtgtgctctgctgcatttatagggtttgggctgctgagaataattgatgctgattaaggtgcaaatcat

SEQ ID NO: 839 - DNA, 246 bp; single-stranded, linear
  immediate source library: MMLR3DT01
  immediate source clone: 569648
gggagaccagggagtgaaaggatcttctggggagcaaggagtaaagggagaaaaaggtgaaagaggtgaaaactcagtgtccgtcaagattntcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctngcac

SEQ ID NO: 840 - DNA, 792 bp; single-stranded, linear
  immediate source library: PROSNOT02
  immediate source clone: 581952
anattaangaggtggatcatcangccccgggcagcccatccacctgtngcagtccctcaaggagttgctactcaagccccacagctatggccgcttcattaggtggctcaacaagganaagggcatcttcaaaattgaggactcagcccaggtggcccggctgtggggcatccgcaagaaaaccgtcccggcatgaactacnacaagctgagccgctccatccgccagtattacaagaagggcatcatccggaagccanacatctcccagcgcctcgtctaccagttcgtgcaccccatctgagtgcctggcccagggcctgaaacccgccctcaggggcctctctcctgcctgccctgcctcagccaggccctganatgggggaaaacgggcagtctgctctgctgctcttgaccttccaaancccaaggtcagggaggggcaaccaactgccccagggggatatgggtcctcctggggccttcgggacctggggcagggtncttcctcctcangcccactgctcccttggaagacaaagggaaacagggntgtccccaacacttcttctgaacccacatttccaaaacaaaacctacaaaaggcatgaatcnacaaaggccncaggcattcaggcttttnttngttcatccccttgcctccctttcttgcacnaaccttggatgtgcaaggaaatttnnncccttantttggcanccagaatnccccccggaaatgatattaaaatcttgaaaactgaaataaaaaataaaaaatggggccctnaaaaaa

SEQ ID NO: 841 - DNA, 239 bp; single-stranded, linear
  immediate source library: PROSNOT02
  immediate source clone: 585906
ggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtcca

SEQ ID NO: 842 - DNA, 1754 bp; single-stranded, linear
  immediate source library: UTRSNOT01
  immediate source clone: 589144
cgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcaccttcacggctccatcttctccggaactgagcagggaaccttctcaactgtggggttgcgtgcccggggagctgccctcgccagggaaggtgcgcacgggacttcggggaagccaggtgacaaggaaatggcgatgctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtatccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaaggaggaaaatnttngagggtnggcgtnggnactnaggnccccanagttgcgngtngttttgggagggagagcccntntnccccttttctntnttagagggactcttagtgtcttgtncaactnttaaatttncaaatgttnaagtagntttttttncancntncnaaatagctnanttntnaaccc

SEQ ID NO: 843 - DNA, 1105 bp; single-stranded, linear
  immediate source library: UTRSNOT01
  immediate source clone: 589345
gtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttgtgattcgggccaaaatctccagtgagaaggtagttccggccagtgcagaccctgctgacactgaaaaaatgctccggtatgaaatcaaacagataaagatgttcaaagggtttgagaaagtcaaggatgttcaatatatctatacgccttttgactcttccctctgtggtgtgaaactagaagccaacagccagaagcagtatctcttgactggtcaggtcctcagtgatggaaaagtcttcatccatctgtgcaactacatcgagccctgggaggacctgtccttggtgcagagggaaagtctgaatcatcactaccatctgaactgtggctgccaaatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcaggggaaggggccatgacttttctgccctgccctcagcctgttgcccctgcctcccaaaccccattagtctaaccttgtagctgttactgcaagtgtttcttctggcttaatctgttttctaaagccaggactatccctttcctcccagaatattttttcctttgtcttaatcgatctggtaggggaaaaatggcgaagtcatacacatgaaaaggtataacctgcaagttcattatcgaaagtggttgacgcacataaaaggcgaatggcaggaatga

SEQ ID NO: 844 - DNA, 239 bp; single-stranded, linear
  immediate source library: UTRSNOT01
  immediate source clone: 589487
ccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggattac

SEQ ID NO: 845 - DNA, 256 bp; single-stranded, linear
  immediate source library: BRSTNOT02
  immediate source clone: 599596
agttaacaagtgacctggggcgcgccggcacgagactgcaggagcttctgaagacgacccaggagcagctggcaagggagaaggacacggtgaagaagctgcaggaacagctngaaaaggcagaggacggcagcagctnaaaggagggcacctctgtctgagtttcctcttttggaaaagaagttactgttcaaacttaccaaaatgncttacacatttcttacaaataaaccaaccaactacacaggttattccg

SEQ ID NO: 846 - DNA, 285 bp; single-stranded, linear
  immediate source library: BRSTNOT02
  immediate source clone: 600663
gttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaaggggacatgttttactctttgcacggaactttcattgttaatgtatattattcagnaacattgtattgtaccataaaacttgtattatcaaactgttggatgttcatgtgttt

SEQ ID NO: 847 - DNA, 501 bp; single-stranded, linear
  immediate source library: BRSTTUT01
  immediate source clone: 602926
ctttggcctgtacccccagagaacaggattcttcccttctttttggccaccaaatgcctatgtgcatcacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtnantttttccatcgccctggacaagacgaggaaacttgtcaacctgaatgtgggaggctttaagcagtctgttgaccaaagcaccctcctgcggtttcctcacaccanactggggaaagctgcttacttgccattctgaanangccattctggagctgtgtgatgattacagtgtggccgataaggaatactactttgatcggaatccctccttgttcagatatgttttgaatttttattacacggggaaagctgcatgtca

SEQ ID NO: 848 - DNA, 891 bp; single-stranded, linear
  immediate source library: BRSTTUT01
  immediate source clone: 605666
tnnnnnnnnnnnnncncnnnatcttggcctatggncncgctnnctttaaaaagggttnggccgggnccncgatatanagggtgacanatggctacaaactggtcgtaggccatcacactcaggancatgtctctcttccctgcctccaaaaatggcaaagagagacatctgagtcaggcagcctgcatagganatgactctgctgtgagactggatgtccacaatcatcttggggaccgtgtggaggtgaaaccgatgtcaggcaaggacaggttggagaggaagaagtacatggggtgtggaggtgggagtcagggctgacggccaggatgatgagcaggttctccagcnccntnnccnggcacatggacaggaacagcccancgacnactggctgcagttctggatccccgacatctgttanattcngtgggtctgtatcgtttggatacaaccctcttttgcctggaaaaaganggttgaaaaatcggaaacaagttaaaccaatacccnncattgtgtctgcattttggatagaancaattcncaagtttatgttttcagatttcngaacaatccacactcagcaatattttgttattctgacaaactccattgtcttataatgctttcatccntcgattgctgtgttnttcnctcttgctgttcaccccgccttananacactagcttccagaacttcccagaaaccanatcgtcctntntaacaatccttaatgctanaaaatacacctatcttttccgaaggaaaagangttataaaaccttgtctcccttttaaaaaaagttncccanttaaggaattaaaacncaattttttttttcccaanttgaacaatccctgatttaaactttgtaccccgttacacg

SEQ ID NO: 849 - DNA, 278 bp; single-stranded, linear
  immediate source library: COLNNOT01
  immediate source clone: 607820
ccaggagatgccagatggctgcaggggcctttgtcccccgcttaccactcacccaattccacccccctcaccccatcccaccctccgagtgaagagagcaaacacctacgccctgttttccaatccaggagaagttctcacaaacggatatcctgatcctaatgacagcggccatctgccacgatctggaccatcccggctacaacaacactggccggcacagcacaggtcagcagaggccttgaccacagcatcccagtgaacctcagcctcgttct

SEQ ID NO: 850 - DNA, 1512 bp; single-stranded, linear
  immediate source library: COLNNOT01
  immediate source clone: 608819
aacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatcctt

SEQ ID NO: 851 - DNA, 781 bp; single-stranded, linear
  immediate source library: COLNNOT01
  immediate source clone: 609792
ggtccgnatgttggatgtttgtagcagtcagagagcagaacatgagcatcngcnaggtcnggntcccccaccatcagggatgggagtgagaaaggggagttcccctctgaagagccacccctgcagggagaaatctgtctccaacaggagatctgggaagaccatagtgagaagtgctgtcgaagaggtccgcacagcggcgccttttccgaagtggttttagcgaagagaaggcaactggcaagctctttgctgtgaagtgtatccctaagaaggngctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtacnatctccacagaatggggatngtccacagagacctcaagcccgaaaatctcttgtactacagtcaagatgaggagtccaaaataatgatcagtgannttggattgtcaaaatggagggcaaggagatgtgatgtccantgcctgtggacnccaggctatgtcgctccngaagtcctngcccagaaaaccttanagnaaagccgttgaacngccgtccatcgagtgattgncnanntcttgggntgggannaanccncctttttatgatgaaaatggnc

SEQ ID NO: 852 - DNA, 263 bp; single-stranded, linear
  immediate source library: COLNNOT01
  immediate source clone: 609982
cgttcctgagccgtaacctggaagaacccaagcaccaggnctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccat

SEQ ID NO: 853 - DNA, 697 bp; single-stranded, linear
  immediate source library: COLNNOT01
  immediate source clone: 611390
gagggnntccccctcccncccgggccannaggggncncgcgcttttncccacactgtgagcntcagcagctccagccagcggacccgacggctgaaantgtcctaaccgctttggagagcgataacttgagttaaagcacctgtctgtgcctggcctccagcagatcttggtccagtgagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagangcactaggcgccctccttgaatttgcctatacagccacactgaccaccagcagcgccaacatgccagctgtgctccaggctgcccgcctgctggggattccgtgtgtcatcnctgcttgcatgganattctgcagggcantgggctanaactcccacccggacnaagatgactgtgagcaacccccantatctggaagcctttgccacanccacggctctggn

SEQ ID NO: 854 - DNA, 261 bp; single-stranded, linear
  immediate source library: PGANNOT01
  immediate source clone: 618092
attttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggatagagagtttttca

SEQ ID NO: 855 - DNA, 272 bp; single-stranded, linear
  immediate source library: PGANNOT01
  immediate source clone: 619240
gcgtggggctggcctggctggccgtgggcagcatgtgcctcttcatcgccggctttgcggtgggctgggggcccatcccctggctcctcatgtcagagatcttccctctgcatgtcaagggcgtggcgacaggcatctgcgtcctcaccaactggctcatggcctttctcgtgaccaaggagttcagcagcctcatggaggtcctcaggccctatggagccttctggcttgcctccgctttctgcatcttcagtgtccttttcactttgttc

SEQ ID NO: 856 - DNA, 247 bp; single-stranded, linear
  immediate source library: PGANNOT01
  immediate source clone: 619292
tccagccgcagctccagcaccgaggacttctgctacgtcttcanggtggagctggaacgaggcccctncgggctggggatgggcctgatcgacgggatgcacacgcacctgggcgnccccgggctctacatccagaccctgntcccgggcagccccgcagcggccgacgggcgcctgtngntgggggaccgtatcctggaggtgaatggcagnagnctcctggggcttggtacctgagagctgtgga

SEQ ID NO: 857 - DNA, 267 bp; single-stranded, linear
  immediate source library: PGANNOT01
  immediate source clone: 621179
ggacacggctggccaggagcggtttcggtcagtgacgcggngttattaccgaggggcggctggagccctactagtgtacgacatcaccanncgggagacatacaactnactggctgcctgggtgacggatgcccgtaccctggccagccccaacatggtggtcatnctctgtggcaacangangaacctggaccctgagngggagttcactttnctggnnnactncngctttngccaggagattnagctgatgtttctggtgancat

SEQ ID NO: 858 - DNA, 252 bp; single-stranded, linear
  immediate source library: KIDNNOT05
  immediate source clone: 627813
taatttttcatccagaacagaatgttcaaaaacgcaagaggagcttcaaggctgtggtgacagctgccaccatgcaaagcaaactgatccaaaaaggnaatgacagaccaaatggcgaggtgaaaagtgaactctgtgagagtcttgaaaccaacacttnctntaccaagacaacatatatcagttacagcaatcattcaatctgaaacagggaaatggcacaatctgaagagatgtggtatatgatcttaa

SEQ ID NO: 859 - DNA, 242 bp; single-stranded, linear
  immediate source library: KIDNNOT05
  immediate source clone: 629242
ctaaaggcccctcctgccccagccctgactcttgcccctgtgccctcccaatacctctgcacancccgccaagaccatggcttgatcgtgagtggacccagcaaggaccccgatctggccagtgggcacggtccctacagcttcanccttggtcccaaccccanggtgcaacgggattggcgcctccagactctcaatggttcccatgcctacctcancttggccctgcattgggtggagcc

SEQ ID NO: 860 - DNA, 266 bp; single-stranded, linear
  immediate source library: KIDNNOT05
  immediate source clone: 632097
tccaagtccttgaacatctttggctcttcttgggagtgtccaacccatgttcagaaacggcacatggaatactcatgtaatggaggaaagtctatatctgcagctggacccagccataccaggggtgtattttggaaatccatacccgtttgggattgatccgatttggaacttgggttcaaacaaacttacatttctgaacttgtataaaatgaaggtgtcggtgatcctggggaattgtncagatggtttttggtgtcaacctc

SEQ ID NO: 861 - DNA, 1740 bp; single-stranded, linear
  immediate source library: NEUTGMT01
  immediate source clone: 632449
cttgatgcatgcacagatttatcaagctcctcagtcaacaaacacatcaccggaagaaacatggaaggaaaggaattttaaaaggaaataccaatctctgtgcaaacaaagccttgtatattcatgtttgcaccaatctactgtgagatttatgaagaaaaacaaattgcggacaactctctatgtacacttacaaatgcctcagttgatgcttgtgggctgtttgtcagcgttctgtgataatgaacacatggacttctgtttattaaattcagttgacccctttagccaattgccaggagcctggatttttacttccaactgctgatatctgtgtaaaaattgatctacatccaccctttaaaagcattgatgaattaattagaactttagacaacaaagaaaaattgaaaaagaattctcagtaaaagcgaattcgatgttcaaaacaaactacaaagagacaagacttctctgtttactttctaagaactaatataattgctaccttaaaaaggaaaaaatgaacagcacatgttttgaagaacagcatgacctggatcactatttgtttcccattgtttacatctttgtgattatagtcagcattccagccaatattggatctctgtgtgtgtctttcctgcaagcaaagaaggaaagtgaactaggaatttacctcttcagtttgtcactatcagatttactctatgcattaactctccctttatggattgattatacttggaataaagacaactggactttctctcctgccttgtgcaaagggagtgcttttctcatgtayatgaatttttacagcagcacwgcattcctcacctgcattgccgttgatcggtatttggctgttgtctaccctttgaagttttttttcctaaggacaagaagatttgcactcatggtcagcctgtccatctggatattggaaaccatcttcaatgctgtcatgttgtgggaagatgaaacagttgttgaatattgcgatgccgaaaagtctaattttactttatgctatgacaaataccctttagagaaatggcaaatcaacctcaacttgttcaggacgtgtacaggctatgcaatacctttggtcaccatcctgatctgcaaccggaaagtctaccaagctgtgcggcacaataaagccacggaaaacaaggaaaagaagagaatcataaaactacttgtcagcctcacagttacttttgtcttatgctttactccctttcatgtgatgttgctgattcgctgcattttagagcatgctgtgaacttcgaagaccacagcaattctgggaagcgaacttacacaatgtatagaatcacggttgcattaacaagtttaaattgtgttgctgatccaattctgtactgttttgtaaccgaaacaggaagatatgatatgtggaatatattaaaattctgcactgggaggtgtaatacatcacaaagacaaagaaaacgcatactttctgtgtctacaaaagatactatggaattagaggtccttgagtagaaccaaggatgttttgaagggaagggaagtttaagttatgcattattatatcatcaagattacattttgaaaaggaaatctagcatgtgaggggactaagtgttctcagagtgatgttttaatccagtccaataaaaatatcttaaaactgcattgtacagctccctgccctgcgttttattaaatgatgtatattaaacaaa

SEQ ID NO: 862 - DNA, 450 bp; single-stranded, linear
  immediate source library: NEUTGMT01
  immediate source clone: 633696
nccgttaaaantagccggngtcccacgtgtnngtgcaccacaatgactacagtgatggcagaagaacatttccccgaatacggcgtcatcaaggcaacttgttcaccctggtgccctccagccgctccctgagcacaaatggcganaacatgggtctggctgtgcaatacctggacccccgtgggcgcctgcggagtgcggacagcgagaatgccctctctgtgcagganaggaatgtgtcaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctganacaagcaaggaggtgagtgctctggantgcganatccagttgctaaagaacttgcagcnnn

SEQ ID NO: 863 - DNA, 901 bp; single-stranded, linear
  immediate source library: NEUTGMT01
  immediate source clone: 635376
nttccttccnnacgcccacgcgtccgnggaccagagttgtangcgcaaagcttnaggaaaggagagtgtggagaggggcctggtgtggtggggcccggtgtttgggaccggagggtgttgacggctgatgagttccttgggtttgctctttcttcacctgaaaagaatactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcncccggaagttgggagcccaactatcccgcggcttcgccggaccccgaaacttctcgactgcactttaggcagctgcgttaccaggaggtggctggaccggaagaagcgctgagccggctccgaaaactctgtcgttcggtggctgaaacccgagctgctctccaaggaaccaaaatcctggaactgcctggtgctggaccattncccccccatccctgccccgaaggaaccttccaacctnggttnccnaaaacnctgccccaaaaaacccgggaaagaaagccggtggccctttgnttccgggcttttccaccaaaccccccaatngaaaccccnncccccggggaaaggtnnactttccnagaaaccgggttntttcntaacctggggaaaaatttggaaccccccngaacccccccccgganggacttncccccaaaaattncccccaaaagaatnccgggaacccctttcccccnattttggaaacccnaattggaaaacaaaatttatccctncnccctttttaaaaaaancgaaccccngggcccttnnaaaactttccg

SEQ ID NO: 864 - DNA, 247 bp; single-stranded, linear
  immediate source library: NEUTGMT01
  immediate source clone: 637331
gccctacacagatatttgagcatgtgttcctgggctcagaatggaatgcctccaacttagaggacttacagaaccgaggggtacggtatatcttgaatgtcactcgagagatagataacttcttcccaggagtctttgagtatcataacattcgggtatatgatgaagaggcaacggatctnctggcgtactggaatgacacttacaaattcatctctaaagnaaagaaacatggatctaaatgcct

SEQ ID NO: 865 - DNA, 262 bp; single-stranded, linear
  immediate source library: BRSTNOT03
  immediate source clone: 639017
tccgggtggtcccattcatatcagtggagcacattcccaaagggaacaactgcctggatgcagcgaaggcctgcaacctcgacgacatttggaagaagtacaggtcggcgtacatcaccccgtgcaccaccagcgtgtccaacgatgtctgcaaccgacgcaagtgccacaaggncctncggcagttctttgacaaggtcccggccaagcacagctacggaatgctcttctgntcctgccgggacatagnctgcacagagcg

SEQ ID NO: 866 - DNA, 931 bp; single-stranded, linear
  immediate source library: BRSTNOT03
  immediate source clone: 639489
anccggnagccgtctcaggtccctgggggaaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaanaaaatggagatgtttacatttttgttgacgtgtatttttctacccctcctaagagggcacagtctcttcacctgtgaaccaattactgttcccanatgtatgaaaatggcctacaacatgacgtttttccctaatctgatgggtcattatgaccagagtattgccgcggtggaaatggagcattttcttcctctcgcaaatctggaatgttcaccaaacattgaaactttcctcctgcaaagcatttgttnccaacctgcatagaacaaattcatgttggttccaccttgtcgtaaactttgttganaaattatattcctgattgccaaaaattanttgacncttttgggaaccgatggccngangancttgaatgttgncagaattaccatacngtgaananacngtccctgtccttttgntccncccccagaatttccttngtccctcggaanaaaanccaacnttccanagagacnttggaattttggtgttccaaggcatccttangactccggggggacaaggatatnntttctgggaattgaccattttncccnccntccccaccntttttttaaaantnatnaactananttgccaaaatttttnttggaantttccatatttgtccttnttcaccctttcncatccctacntttttntnnantttaaaantccgaanccccnaaaacct

SEQ ID NO: 867 - DNA, 271 bp; single-stranded, linear
  immediate source library: BRSTNOT03
  immediate source clone: 639750
cgatgagaagcctttctnctgtgaagagtgtggggcgaagtttgnagccaattccaccctgaagaaccaccttngncttnanancggggaccgcccgttcatgtgcaagcactgcctcatgaccttcanccaggnctccgncctggnctatcacaccaagaagaagcactcagaagggaaaatgtatgcatgccagtactgtgatgctgtgtttgcccagtctattgagctgtcccgncacgtgaggacccacancggggacaagncctat

SEQ ID NO: 868 - DNA, 265 bp; single-stranded, linear
  immediate source library: BRSTNOT03
  immediate source clone: 640759
gccctcaggaccctattatggccactcgggccaggnctctggcctctactcggncttctcctatatggggccctcgcagcggcccctctacanggccatctctgaccccagcccctcagggccccagtcccacagccccacacactgggagcagccagtatatacgacantgtcccggccctaaagggggccctgtngncancancngccgnccagcccctgcccccagcctgtgtgncctgttncttgcccancttaggnctgg

SEQ ID NO: 869 - DNA, 258 bp; single-stranded, linear
  immediate source library: BRSTNOT03
  immediate source clone: 641384
ggaaccccatgactgtncaaaatgatcttagcctctgagaagtacagctgttcagaggagatccngacagtggctgccatgctctctgtcaacaactncatcttctaccgaccaaaggacaaggtcgtccatgctgacaatgaccgtgtcaacttctttctncctggcggtgaccacctggttctgctaaatgtttacacacagtgggctgagagtggttactcttnccagtggtgctatgagaactttgtacagttt

SEQ ID NO: 870 - DNA, 4078 bp; single-stranded, linear
  immediate source library: BRAINOT03
  immediate source clone: 662342
gaattcccgggtcgacccacgcgtccgccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccrtcgacttgcgagccatcgggaagctgcccatcgccatgagggccctcaccaactaccaacggctctgcgaggcctttgacgcccagcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgyaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtacctcaaggacttccagaggtctgaatgccagctctttgagcactggaagacctcatgaaccgacaggaccaagagctggagaaggaaatgtcacagagagaaaagccacagagccacccagggcctatctcgtgccatgtcctcgaagggatggccttctgcaggatgaggaagaggaggaagaggaggcagctgagaacgaggaggatgactacctgtcgtccatgctgcaccagcgtgctgagatcccatggcgagcctgcnccaagtacctgtcctccgccggcatcctgctcctgtcgttgctggtcttctcacagctgctcaagcacatggtcctggtggccatcgactactggctggccaagtggaccgacagcgccctgaccctgacccctgcaaccaggaactgctccctcaaccaggagtgcaccctcaaccagactgtctatgccttggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagagagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatc

SEQ ID NO: 871 - DNA, 265 bp; single-stranded, linear
  immediate source library: CRBLNOT01
  immediate source clone: 669862
tgcttttccacattcattacattcatagggtatcacaccagtatggtctctcagatgttcagtaaggtgcaaatattttctaaagcccttcttatattccttacactcatatgatttctctcttgtgttatttctcttatgtagaggaagggatttatgttttttgaatatcatttgactaaaacatcccactttaggtctctgttgtctcccaaattcaattgtgtactgtgggtcagttctgaaaataaacctcataaggttg

SEQ ID NO: 872 - DNA, 890 bp; single-stranded, linear
  immediate source library: CRBLNOT01
  immediate source clone: 670279
natatntgcctcgagtcnttcatagaaagcgcgacagtgtgggaccctggctgtaanaccgagagttncaaggagggtgaggagggacagccccgccngctgacncccttcganaaactgacacaggacatgtcccaggatgagaaggtggtgagggagatcacgctggggaaacggataggcttctaccgaattcgaggggaaatcggaagtggaaacttctcccaagtgaagcttgggattcactccctaaccaaagaaaaggtggccattaagatcctggacaagaccaagttagaccagaaaacccagaggctactatcccgagaaatctccagcntnnntnngctgcaccatcccaacatcatccgcctttacgaagtggtggagaccctatccaacctttnaaaaannnnnnnnnnnnnnnnnnnnnnnnnngnnnnnnnnnnagnntgnnngnnnnnnnnntnngnggnnnnannaaatttccccngggggttcgacccacngccgttccncccgtggggatcngcgccnacantgttanaaagttggctgtcagacccnagaagttttcaaggaagggttgaggagggacagccccgcccagcttgacgccctttcgagaaactgacacaggacatgtcccnngatgagaagtggtgagggagatcacgctgggggaaacggatagcttctaccgaattccangggaaatcngaantggaaacttctcccaagtgaacttgggattcctccctaaccaagaaaagtggccattaagatcctggacaagaacaatttagnnaaaaaaccagagctactatcccaaaaatctccanatggaaaactgcncatccaactctccgctttacaaatggtgganaccn

SEQ ID NO: 873 - DNA, 262 bp; single-stranded, linear
  immediate source library: CRBLNOT01
  immediate source clone: 670448
gccgcgggcccgggggcagctgtgagttctgcgggaagcattttaccaacagcagcaacctgacggtgcaccggcgctcacacaccggggagcgcccctacacctgtgagttctgcaactacgnctgcgcccagagcagtaagctcaaccgccaccgncgnatgcacggcatgacggctggcagcacccgcttcgagtgcccccactgccatgtgcccttcggnctgcgagccaccctggacaaacanctgcggcagaagna

SEQ ID NO: 874 - DNA, 268 bp; single-stranded, linear
  immediate source library: CRBLNOT01
  immediate source clone: 671514
gaggccaggggggcatccgtgcccggctcaggcccatcgacgnagacaccattgacatttacgnccgcgctgtgttccctgcggcgtttgcggccgtcaatgtcatctactgggcggcatacgccatgtgagcacaggactcaggccaccctcgnttgtcctggcgcccggnggcagctgcccagaaacttcctgggagaaagagccctcgggctgccttcccctctgcgtgtttcgaagtgggatgacagtcggccacggaaaacaa

SEQ ID NO: 875 - DNA, 890 bp; single-stranded, linear
  immediate source library: CRBLNOT01
  immediate source clone: 674892
tggatgggttccggccttaattaaanccgganngtcccgggcccnncanaacaggggnccgatgtacaccaggtctgttctcagagcgatgggccncggagactgatctgccgccatgattggaggcttattcatctataatcacaagggggaggtgctcatctcccgagtctaccnatatgacatcgggaggaacgcagtggatgcctttcggatcaatgttatccatgcccggcagcaggtgcgcagccccgtcaccaacattgctcgcaccagcttcttccacgttaagcggtccaacatttggctggcagcagtcaccaagcatantttnttnnctgccatggtcttcgaattcctctataanatgtgtgacgtgatggctgcctactttggcaagatcagcgaggaaaacatcaagaaacaattttgtgctcatatatgagctgctgggaggaagattctagactttggctacccacagaaattccgagacaggcgcgctgaaaaccttcatcacgcagcagggcatcaagagtcaggtacttgaattgtgcanactatagtcagggtggantccaatctcccttcatcccagctggccctganccttgtctganctgactcatganccctcccatgacaggaagtgctggcctgacctcctgccatgattgcaggccgattttgctctgttttgtcctcccactgcaggancagccaattcacatctctattaccaggaatacagctcaacatttccttttgccccaagggtngggaagaagcctggtcttaagcctggtttcctcaggaagacaacttgggcctctctctangatcaacctcatactttcccccctttctgcccccttgcgctcatntnggcn

SEQ ID NO: 876 - DNA, 138 bp; single-stranded, linear
  immediate source library: CRBLNOT01
  immediate source clone: 674947
gacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaacta

SEQ ID NO: 877 - DNA, 257 bp; single-stranded, linear
  immediate source library: CRBLNOT01
  immediate source clone: 675190
atggcctggcttcantttaaaaancccagctnaggtcccaggaaacacatgaaaaatgncacnattgtaatgtctgtgaggagagagcaaggcanttcttcaggggaggggtcattgtcattcgaaaatgtggctgtgggcttcactagggaggagtggcagtttttggaccantctcagaaggtcttgtacaaggaagtaatgttggagaactacatcaacctagtatcaatagggtatcgaggcaccaaggannn

SEQ ID NO: 878 - DNA, 253 bp; single-stranded, linear
  immediate source library: CRBLNOT01
  immediate source clone: 676592
ggctgaggctatgatggcggccatggcgacggctcgagtgcggatggggccgcggtgcgcccaggngctctggcgcatgccgtggctgccggtgtttttgtngttnnnnnnnnnnnnnnnnnnnnnnnnnnnnnnncagcaggtcccgctggtgctgtggtcgagtgaccgggacttgtgggctnctacggccgacantnatgaaggccacatcaccanngacttgcagctntctacctanttagatcccgnc

SEQ ID NO: 879 - DNA, 260 bp; single-stranded, linear
  immediate source library: CRBLNOT01
  immediate source clone: 677049
gaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagnattnatactggagagaaaccct

SEQ ID NO: 880 - DNA, 475 bp; single-stranded, linear
  immediate source library: CRBLNOT01
  immediate source clone: 678003
ggcaaagcttttagtatgcgttcaagcctcactaatcatcatgcgatccacactngagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggangaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggnttcttcaaagaattcttgctggtgagaaacctaacaaatgtaatgaatgtggcaaggtcttctggcacaattctcacattgtacaatattgcaaaaattcatgct

SEQ ID NO: 881 - DNA, 232 bp; single-stranded, linear
  immediate source library: UTRSNOT02
  immediate source clone: 679760
agaaacgggacagttnaggaggaaaggaagagaagaaacatnataagtnctcggacaagcacagataatgaagactttncatnaaggntatggacagacccgtaagccgaaagtctcccagaggaggatgccaaagtccgtgcgtcatctcagatgtatctcccatanttaagagttntggtgctgtccatttaatgggatctgctttaagtcagaagtgagtacacaccac

SEQ ID NO: 882 - DNA, 269 bp; single-stranded, linear
  immediate source library: UTRSNOT02
  immediate source clone: 680833
gttttntttgctgccaaaaccctccggaactacaaacccaacatggtggagaccatggttcagtaccacttttnctacgatgtggccctggagtacttggaggggctggagtcaagatagcggggccctggcctggggcacccactgcacactcagggccagacccancattctggactggngaggaagatcagtgccttctnntntgcccaaacacacttcnatggggcaagcactggagtngatnctgggctattttgctccccctg

SEQ ID NO: 883 - DNA, 268 bp; single-stranded, linear
  immediate source library: UTRSNOT02
  immediate source clone: 683211
agaggatgagtatgaccctgtatttctggnaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcancaggnagcggaacagccaactctgggggtgggggccggacccggngggaagca

SEQ ID NO: 884 - DNA, 275 bp; single-stranded, linear
  immediate source library: UTRSNOT02
  immediate source clone: 684126
tgtggacgaggctttatccaaaagtcaaccttcactttacaccagaggacacactnagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtnagaaaagttttagtttgaa

SEQ ID NO: 885 - DNA, 257 bp; single-stranded, linear
  immediate source library: UTRSNOT02
  immediate source clone: 685434
gagagatgctctatctggctactcgtatcgaacaagaaaatgttatcaatcacacggatgaagaaggatttactcctctgatgtgggctgcagcacaagggcaaatagctgtggtagagttcctacttcagaatggtgctgatccccaacttttaggaaaaggtcgagaaagtgcactgtcgttggcctgtagtaaaggctacacagatattgtcaaaatgctgcttgattgtggngttgatgtaaatgaatatgat

SEQ ID NO: 886 - DNA, 272 bp; single-stranded, linear
  immediate source library: UTRSNOT02
  immediate source clone: 687223
cggagacatccaggagggcgacctggtggaggtggtgctgtcggcctcggccaccttcgaggacttncagatccgnccgganggcctnacggtgcactnctatcgggcgctgccttctgtgatcactgcggggagatgctcttcggcctagtgcgccagggcctnaagtgcgatggctgcgggctgaactaccacaagcgctgtgccttcagnatncccaacaactgtagtggggcccgcaaacggcggctgtcatccacgtctttggccag

SEQ ID NO: 887 - DNA, 251 bp; single-stranded, linear
  immediate source library: UTRSNOT02
  immediate source clone: 688183
gcgaggagctggcacgcagccagggcctttgctcaagaagccataccagccaagaattaaaatctctaaaacatcagtggatggtgatccccactttgttgtggntttccccctgagcagactnancgtgtgcttcaacattgatgggcagcccggggacatcctcaggctggtctctgatcacagggactntggtgtcaaagtgaacggagagttaattggggcaaccggccctncaaatggccacaaga

SEQ ID NO: 888 - DNA, 260 bp; single-stranded, linear
  immediate source library: LUNGTUT02
  immediate source clone: 689078
cagaaagactgtctttgaaaagagagttgagttggtatagaggccgaagaccaagaactgcttttactcaaaaccagattgaagtgttagaaaatgtctttagagtaaactgctatcctggtatcgatattagagaagacttagctcaaaaattgaatctagaggaagacagaatccagatttggtttcaaaatcggcgtgcaaaactgaaaaggtcccatagaggatcacagtttctaatggcgnaaaaaaatttcaac

SEQ ID NO: 889 - DNA, 243 bp; single-stranded, linear
  immediate source library: LUNGTUT02
  immediate source clone: 689776
ccangggtccgatttctgctggntccaggnctttggccatctataaagcttggcaatgagaaataagaaaattctcaaggaggacgagctcttgagtgagacccaacaagntgcttttcaccaaattgcaatggagcctttcgaaatcaatgttccaaagcccaagaggagaaatggggtgaacttctccctagctgtggtggtcatctacctgatcctgctcancgntggcgctgggctgct

SEQ ID NO: 890 - DNA, 253 bp; single-stranded, linear
  immediate source library: LUNGTUT02
  immediate source clone: 690231
gattccacaaaagttcatagttgactattctgaaaccagcccccagtgccccaagccagggtgttaatcctcctaaccaagagaaggccggcaagatcttgtgctgaccccaataagaagtgggtcccagaaaatacatcagcgaccctgaagcttgaatgccctgaggggccctggaagctgcgagggcccagtgaactttggtgggcccaggagggaacaggngctgagccagggcaatgggcctgncaac

SEQ ID NO: 891 - DNA, 205 bp; single-stranded, linear
  immediate source library: LUNGTUT02
  immediate source clone: 692341
ctcgcatcttgttgcacatcagagaactcacacaggggagaaaccttatgaatgtagtgaatgtggaaaatccttcagccggagctcgcaccttgtttgccatcagagaactcatactggagagaaaccttacaggtgtaatcaatgtgggaaatcctttagccagagttatgtccttgttgtgcatcaaagaactnatactggg

SEQ ID NO: 892 - DNA, 857 bp; single-stranded, linear
  immediate source library: SYNORAT03
  immediate source clone: 693783
tngngtccntctngccagattaagatngggccgaggagaacctaactgtnttcaatgtgaaacagccttcagccaacatctgncatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaataccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatganaactcccactggtgagaaccttatcaatgttaggaatgtggaaaanctttattaattcctcttcctttaaaattccatgcagacctcctggtgttaaacctatgatgtcacatgtgggaaagcctcatcgatctc

SEQ ID NO: 893 - DNA, 280 bp; single-stranded, linear
  immediate source library: SYNORAT03
  immediate source clone: 696484
ggccgccgcgagcccgctttccaccccgacctctgcccaggncgcagccncagctcaggctcgtgcccacccaccaagttccagtgccgnaccagtggnttatgcgtgcccctcanctggcgctgcgacagggacttggactgcagcgatggcagcgatgaggaggagtgcaggattgagccatgtacccagaaagggcaatgcccaccgncccctgggcttccctgcccctgcaacggcgtcatgactgctttttgggggaactnacaagaaaanttgg

SEQ ID NO: 894 - DNA, 243 bp; single-stranded, linear
  immediate source library: SYNORAT03
  immediate source clone: 699542
gccangngtccggtctggatgggttactataaccaacagtacccaaggtggctgtgaaaaccctgaagncaggnactatgtctgtgcaagcttnctggaagaagccaacctcatgaagaccctgcagcatgacaaggttgtgaggctnttacgntgtggtcancagggaggagcccatttanatcatcancgagtaaatggccaagggcatttncttggnttttctgaagggcgattgaaggt

SEQ ID NO: 895 - DNA, 277 bp; single-stranded, linear
  immediate source library: SYNORAT03
  immediate source clone: 700261
cagaagctcctccagaagtgcccggagaagcgcctcggggcaggtgagcaggatgccgaggagatcaaggtccagccattcttcagggtgagcggctggggtggcggtggtcccctgtgcctggcagggtaggtggcatggagtgactcctggagctgctgttcctgccgtctcaggcgcctctcctttgccctcagaccaccaactggcaagccctgctcgcccgnaccatccagccccccttcgtgcctaccctgtgtggccctgcggacctgcg

SEQ ID NO: 896 - DNA, 262 bp; single-stranded, linear
  immediate source library: SYNORAT03
  immediate source clone: 700322
aaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcag

SEQ ID NO: 897 - DNA, 293 bp; single-stranded, linear
  immediate source library: SYNORAT04
  immediate source clone: 704164
tggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcac

SEQ ID NO: 898 - DNA, 215 bp; single-stranded, linear
  immediate source library: SYNORAT04
  immediate source clone: 705322
ccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagc

SEQ ID NO: 899 - DNA, 841 bp; single-stranded, linear
  immediate source library: SYNORAT04
  immediate source clone: 705365
tccgttcgnccntgggcgcnaccggacncnttnccnttactatggcnntgacggcagggactacaacaacctttcctatgagcaaccatacccgggaaagagtgactgtagccaagctcacattggagaatttttatagcaacctaattttacagcatgaagagagagaaaccnggcngaagaaattagaagtggccatggaagaagaaggattnncnnatgaagagaaaaagttncgtcgatcacaacacgctcgcnaagaaacaganttcttacggctcaaaaggaccagacttggcttggatgactttgagtctcngaantttttttnnatangancttntgganaagtgcggttggtcccnaaaaaaagatacngggccctatcttttgccatgaanaaaattganaaaagttccgattatgccttgaaaaaanaacngggttggcccttttccgaagccagaaagagatattttggtagaagcagatggtgcctgggtggtgaanatgttttacagttttccaggatnagangaatctttttctaatcntggaatttccccctggangtgacctgatgacattgctaatgaaaaaaagacccttgaccgaaaaagaaacccctttctnctttccaaaactgttctngccatggaatccaacccccctttggtttcntccctccggaattttaccccaacacctttnttnggtgccaggtcngtttaattttcngaatttggttttgtttcgggattaagaaacnccccggctgaatttttanaatccccccccnccccccgnttctcncnttctaaaatgatcccnagannaaaaa

SEQ ID NO: 900 - DNA, 241 bp; single-stranded, linear
  immediate source library: SYNORAT04
  immediate source clone: 705546
gctgcacatccacagcgacgtgttctctgagccccgtgccatcttttattccgcctgcgtggtgctgggcctacagtttcttcacgaacacaagatcgtctacagggncctgaagttngncaattggtnctgggcaacgaggggtaagtnaaggatcgnagactttgggctttgcaaggaggggntgggctatggggaccggaccagcaaattctgtgggaccccggagttctgggcccag

SEQ ID NO: 901 - DNA, 250 bp; single-stranded, linear
  immediate source library: SYNORAT04
  immediate source clone: 706386
gtgacaacgagnaatcgcatggaagagagcaaagccttatttaaaaccatcatcacctacccctggtttctgaattcatctgtgattttattcttgaacaagaaggatcttttggaagagaaaatcatgtactctcatctaattagctatttcccagaatacacaggaccgaaacaggatgtcagagctgccagagactttatcctgaagctttaccaagatcagaatcctgacaaagagaaagtcatct

SEQ ID NO: 902 - DNA, 414 bp; single-stranded, linear
  immediate source library: SYNORAT04
  immediate source clone: 706487
cccaaagaatgataangttggttttatttcaagaagtcgatcaaaaagaaagccccagcgctctangagctcagctgacgggaaagggggtgcgcagcttcgagtttgagagctacccggagctccaagacaggggtgggttccagctgcccgcacgncccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttnggaatcttccaggcctgggccgaggccactggtgcatatttncccggaaggaataagccagacctgccaacctggaa

SEQ ID NO: 903 - DNA, 257 bp; single-stranded, linear
  immediate source library: SYNORAT04
  immediate source clone: 707357
aggaaggcaagtatgagtttcctgacaaggactgggcacacatctccagtgaagccaaagacctcatctncaagctcctggtgcgagatgcaaagcagagacttagcgccgcccaagttctgcagcacccatgggtgcaggggcaagctccagaaaagggactncccacgccgcaagtcctccagaggaacagcagcacaatggacctgacgntcttcgcagctgaggccatcgcccttaaccgccagctatntnag

SEQ ID NO: 904 - DNA, 218 bp; single-stranded, linear
  immediate source library: SYNORAT04
  immediate source clone: 709070
gccccctgcctctcccacactggcccatgaggctgcacccctgcccgccgggcggccccgncccaccancaanctnttcancaagctgacctccaaactgacccgaaggtggcagacggaacctgagagaatngggggacctgaggtcacaagttgccatctaccttgggatcaaacggaaaccggcccccggctgctccgattcccctggggtgtga

SEQ ID NO: 905 - DNA, 716 bp; single-stranded, linear
  immediate source library: SYNOOAT01
  immediate source clone: 718593
tggggcgggnnnnntctnnntaattgcntccttgnngactttcggaagaaggcccnggccaaatttgaaacntnacatgncaggagctggaggagggaatgatattcagtggtgtttttctcaggtgaaaggagcagtagatgatgatgtagcagaagatataatttctacagtagaatttaatcattctggagaattactancaacaggagataaaggtggtagagttgtnntctttcnncnngagcaggagaacaaaatncantntcntnncnnanganaaaataatgtttttnntnccttccccaacccnnaaccnnantttgantanttgaanttttttttttttnaanaaaaaanaancccccttttntggtttttccccaaaaaanntgnncccnnttttttnttttcnccccgatanaaacccttaatttttngggaaantcctttaaagggganaaaaaacccaaagggttttttcttntaaaganggaggatggnaaggttntngaagatccctactacagtttactacactacgaatgccgagtctttaggcctatggatctaatggttgaagccagtccacgaaagaaatattttgccaatgctccatacatttcacattcgactccattttcttttgagtaagtggattatggaaaccatttttttcttgccaattaatttggngaattttttttcntaaaaaa

SEQ ID NO: 906 - DNA, 254 bp; single-stranded, linear
  immediate source library: SYNOOAT01
  immediate source clone: 724339
gtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatctcctggctgtactggctgggctgctggtgctagcactgctggtgctgctcctgtggaagtgtggcttcttccatcggagcagccagagctcatcttttcccaccag

SEQ ID NO: 907 - DNA, 851 bp; single-stranded, linear
  immediate source library: SYNOOAT01
  immediate source clone: 727639
ccngccaattaaagnanannggaccggccccacagaaatgctggaggatncactctccagggggttcctgttaaaaaccagagcttcagcttccaaaattacggctgagcttcagtttttccacaagagattgcctaaaggaaccatggagatcagaggggcactcgatctgcgaaaaaggcaagttctaatattccttgttttgctgggattgtctcgggcaggtactgaatctgcacactattctgtggcagaggaaacagaaattggctcttttgtggctaatctagcgagggacctagggctgggggtggaggagctgtcttcacgtgaagcccgggtagtgtctgatgataataaaaagtatttgcaccttgatttgctgactgggaatttgctcctaaatgagaaactagaccgagacgagctgtgtggctccaccgaaccctgtgtgctgcattttcaggtggttttggaaaaccctttatagttttttcggtttganctgtgtgtcaaagacataaatgatcactcccctacatttctagacaaggaaatacttattaaaatatcagaaggtaccactgttggagctacctttctaatggaaantgctcaaatttggatttccgaangacatctcccaaactacacattaccccaatctcacttctacattaaatcccnacagtagtgacagaaaaatatacccaaactgtcctaaataaactttaaattatgaacaggaactgaactcgaataacctcncaccatngatggtgatccccccaatctgganactttggtctcatcagtnttggaatcatnaaaagccccgattccccnatccn

SEQ ID NO: 908 - DNA, 272 bp; single-stranded, linear
  immediate source library: SYNOOAT01
  immediate source clone: 727885
gaactcagtgtcccccccgcaagcattgttgcaagagaatcacccttcggtcatcgtgcagcctgggaagagacctttacctgtggaatccccggatactcaaaggaagcggtggatacacagatgtgattatgatggatgcaacaaagtgtacactaaaagctcccacttgaaagcacacagaagaacacacacaggnganaaaccctacaaatgtacatgggnagggtgcacatgggagtttnctcggtctgatgactnacaagacattt

SEQ ID NO: 909 - DNA, 757 bp; single-stranded, linear
  immediate source library: SYNOOAT01
  immediate source clone: 727914
ttcgctctnnataacgtttcaggcgggcctcctcctaacattcaaactgtntcncccaggagtctgcaaattccccaaagtaggaggaaaaatgaccacattcaagcgcagcggaatgaggaggttcctggtctcttcttcttcttgaacagattaccaagactgtgggaatacttataacctgctcttggccatgataaagagaagcaaagtacttgtattctgttcaaagattatggaggaggcagtgaccttcaaggatgtggctgtggtcttcactgaggaggagctggggctgctggaccctgcccanaggaagctgtnccgagatgtgatgctggagaacttcaggaacctgctctcagtggggcatcaaccgttccaccaaaatacttgccacttcctaagggaaagaaaatttttggatgatggggaacagcaaccccagaagaagaaagggaaattccaggaaggcaagaatcccaaactgaatttggaattctgttcccagaaaccaggaaccacattgaanaattngtccctgcccaccaaattctgggaaacaaattgcaaaaaanttnccagtntccaggantcctntcataaatactccccattctttgaaaatngtgaattttcccccccccggntgaaggngnggaattcccccaatttcctacgggananaaaccttcccaggggtgggaantnttaaaagtncttccgtgaatttcccnctttanacttcccnaataaa

SEQ ID NO: 910 - DNA, 263 bp; single-stranded, linear
  immediate source library: LUNGNOT03
  immediate source clone: 728966
gttttatgaggcccccagatctgtggattggagagagaaaggctacgtggactcctgtgaagaatcagggtcagtgtggttcttgttgggcttttagtgctantggtgcctcttgnaagggacagatggttccggaaaaactggggaggctttatcctcaacttgagtgagccagaattctgggtaggacttgcttctggggcccttaaagggcaaattgaaagggcttgccaaatgggttgggccctnaattgggattttta

SEQ ID NO: 911 - DNA, 247 bp; single-stranded, linear
  immediate source library: LUNGNOT03
  immediate source clone: 731048
ctctttgccaatgagagtgtgcctgaccatgtgggntatgccaaggtgaagatcantctcatcaatgaaaatgacaaccggcccatcttcagccagccactgtacaanatcagcctgtangagaacgtcancgtggggacctctgtgctgacagtnctgtgggaaaanttcttttgcagtaatttcagcagattctnatnggnccaattggttgtgtcatctgggaccaantgtngattttggtatg

SEQ ID NO: 912 - DNA, 772 bp; single-stranded, linear
  immediate source library: TONSNOT01
  immediate source clone: 734390
ncttaanctggggggccccngcctaaggcgggtccttctgannttgtcaccttcgcttggggtcgcaacgacccgatgatcgatgatccaagcaagggaaaagaagccttggcggagagcggaggcacaattccaccttcctttgtgctccattnctcaagactctgaagactccaaaaagtaggaggaaaaatgaccacattcaaggaggcagtgaccttcaaggatgtggctgtgttcttcactgaggaggaactggggctactggaccctgcccagaggaagctgtaccaagacgtgatgcttgntnntttcncgaacctgctgtcagtggggcatcaaccattccaccctttccacttcctaagggaagaaaagttttggatgatggagacagcaacccaaagaagaagggaaattcaggcggcaagactattgcggaagcaggaccacntgaagactgcccttgccagcaaatctgggaacaaactgcaagttgacttaacccagtctcaagactccatcataaataattctcacttctttgaacaaggtgatgtcccctccccaggttgaagcaggactatctataattcatacaggacagaaaccttcacagaatgggaantgtaaacagtccttcagtgattttgcccatcttttgatcctcctcagcaattccactccaggaaanaatctcatacatgcaatganttttgaaaaaagctctgttacatctcactcttcgtattcnccaaaaattcacttgaac

SEQ ID NO: 913 - DNA, 903 bp; single-stranded, linear
  immediate source library: TONSNOT01
  immediate source clone: 735249
tgtaattgtgctcggacggagggtcctagccaaccgctgttttgcccgatgagcccctcttgccacacatgaacggagcacattctgtgaaaatatggtactgatacccttaccccactcggggctgcttccaaccttcaatttgtaaaaaaaccccaaaacctcaggatccccaaaatatcatcaaatgaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgaggggtttccgctggctcttcccagtatattgacttgatgtttnggacgggtgaaaataaaangaggttttacttcttcttggactgatcctattcacagcttctcatgaacttttctaatagaacaaggaaa

SEQ ID NO: 914 - DNA, 221 bp; single-stranded, linear
  immediate source library: TONSNOT01
  immediate source clone: 736663
gttggccatcagtggtcacctagacagcgacgatgatagtggctccggaagnctggttggcattgacaacaaaatcgagcaagccatggacttggtgaagtcccacctcatgtttgcggtccgggaggaggtggaggtgctgaaggagcagatccgggaactggcggagggaacgctgcgctggagcaggngaatgggctnctgcgcgncctgggcanccc

SEQ ID NO: 915 - DNA, 239 bp; single-stranded, linear
  immediate source library: TONSNOT01
  immediate source clone: 737809
gtggcgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgcccacagaacttaattgcccaatctcagtctggtactggtaaaacagct

SEQ ID NO: 916 - DNA, 219 bp; single-stranded, linear
  immediate source library: BRAITUT01
  immediate source clone: 751271
gtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaaca

SEQ ID NO: 917 - DNA, 230 bp; single-stranded, linear
  immediate source library: BRAITUT01
  immediate source clone: 751640
gcagaggctacagatccagaaccccctgtatccggtgaccgagagctcctacagtgcctatgccatcatgcttctggcgctggtggtgtttgcggtgggcattgtgggcaacctgtcggtcatgtgcatcgtgtggcacagctactacctgaagagcgcctggaactccatccttgccagcctggccctctgggattttctggtcctctttttctgcctccctattgtca

SEQ ID NO: 918 - DNA, 740 bp; single-stranded, linear
  immediate source library: BRAITUT01
  immediate source clone: 752848
ccgntntatctaaagcggcatgggtgcgncncgttgccactgcctggcntccctttctcaaggaccaccgcatctctacattcaagaactggcccttcttggagggctgcgcctgcaccccggagcggatggccgaggctggcttcatccactgccccactganaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagattttcaactgtgctcttgttttgtcttaaaantggcaccagaagtgcttctgcctgtgcacgggtgctgctggtaacaatggctgctctctctctctctctcttttttgggggctcatttttgctgttttgatcccnggcttacaggtgagaatgagganann

SEQ ID NO: 919 - DNA, 205 bp; single-stranded, linear
  immediate source library: BRAITUT01
  immediate source clone: 753522
cagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgt

SEQ ID NO: 920 - DNA, 483 bp; single-stranded, linear
  immediate source library: BRAITUT02
  immediate source clone: 754412
cngaagaagnantggccccccccaaaaaaaacattntttcggtgaaaaccattcactaggagaggagaaacacccnggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcntctgaggtgctgcctgttgactcatttggtggcctaagtaaagccccaaagagtcttcctgcaaagtcctcaatacttgggggtcagtttgcaatttgggaaaggtggggccctccacaaagaaacgaagccagactcttgcagcattgctttatcaggaaatgtttacnnn

SEQ ID NO: 921 - DNA, 259 bp; single-stranded, linear
  immediate source library: BRAITUT02
  immediate source clone: 755778
ccagtgggatgcctcaccagagcagcgcttggcaggcccccgcggaggataaacacagtggctgaacaccaggaaggaactggcacttggagtccagacatctgaaacttggaatccttcttggcactgggaatacagaggtgatgnnnnnnnnnnnnnnnnnnnnnnnnnnnnnnnnnnnnnnnnnnnnnnnnnnnnnnnnnnncagcttaagttccttgtagatcatggatattagacaagaaataaagccacacac

SEQ ID NO: 922 - DNA, 760 bp; single-stranded, linear
  immediate source library: BRAITUT02
  immediate source clone: 757359
angcnggtntcaatctacaaggagcctgccttngnccnggaggtgnaggcctcgtctcctgcagaggtgcctgtgtctcagcctgaccccttgccagcttctgaccacagttacgagctgcgcaatggtgaagccattgggcgggatcgccgggggcgcagggcccggaggaacaacagtggagaancaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtanactgtggcctggccttcggcacanaggccctcctcctggcccaccggcgaagcccacaccccgaatcctctgcattcatgtccatgtgggaagacctttgtcaaccttaccaagttcctttatcaccggcgtactcatggggtagggggtgtccctctgcccacaacaccagtcccaccagaagaacctgtcattggtttcccctganccagccccancagaaantggagaccagaagccctgagccccttgttgtctgaagaaaactcagcagggccgctgcccangcacctacgctgcctcctgtgcagccgtgaatttggaaaggcttgcactgaccngcacaacttttgtgcatcggtggcgaaannn

SEQ ID NO: 923 - DNA, 827 bp; single-stranded, linear
  immediate source library: BRAITUT02
  immediate source clone: 757560
agcaaatgaacaatcccaggacttctcaatacacaatgaagattttccagcattaccaggntccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaantggaggaaagtagctaaggagttccatctggaatatgacaaattagaagaacggcctcacctgccatccaccttcaactacaaccctgctcagcaagccttct

SEQ ID NO: 924 - DNA, 227 bp; single-stranded, linear
  immediate source library: BRAITUT02
  immediate source clone: 758754
ggactatttgcactctttggggaaggctcgaacagctcaagtccaaaaagatgcacggattggagaagcagaggccaagagagatgctgggatccnggaagctaaagccaagcaggaaaaggtgtctgctcagtacctgagtgagatcgagatggccaaggcacagagagattacgaactgaagaaggccgcctatgacatcgaggtcaacacccgccgagcacagg

SEQ ID NO: 925 - DNA, 206 bp; single-stranded, linear
  immediate source library: BRAITUT02
  immediate source clone: 761192
cttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtnggaagggctataccactgcctcatactttcttctacatcagaga

SEQ ID NO: 926 - DNA, 215 bp; single-stranded, linear
  immediate source library: COLNCRT01
  immediate source clone: 769786
gtaaaaaaaagttcttctgttatgttggagctcatcagcctgagtgccggcagggaacgaggatccgggccaatctataaaagggagtgtcattagaaaaggagactgtttgatgcccttcaaccacagctcagcaaaggctcctggggtcccgtctgtattgcacagaatcaaaccaaacggatccaccatccacccacctctcttttctgatt

SEQ ID NO: 927 - DNA, 237 bp; single-stranded, linear
  immediate source library: COLNCRT01
  immediate source clone: 773734
aaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggc

SEQ ID NO: 928 - DNA, 1081 bp; single-stranded, linear
  immediate source library: COLNNOT05
  immediate source clone: 774419
gcaaattcttctgtgcctccaatcacagtgaatgctaaaatgaataaggacgtaaacagtttccccagcccaatgattgtttacgcagaaattctacaaggatatgtacctgttcttggagccaatgtgactgctttcattgaatcacagaatggacatacagaagttttggaacttttggataatggtgcaggcgctgattctttcaagaatgatggagtctactccaggtattttacagcatatacagaaaatggcagatatagcttaaaagttcgggctcatggaggagcaaacactgccaggctaaaattacggcctccactgaatagagccgcgtacataccaggctgggtagtgaacggggaaattgaagcaaacccgccaagacctgaaattgatgaggatactcagaccaccttggaggatttcagccgaacagcatccggaggtgcatttgtggtatcacaagtcccaagccttcccttgcctgaccaatacccaccaagtcaaatcacagaccttgatgccacagttcatgaggataagattattcttacatggacagcaccaggagataattttgatgttggaaaagttcaacgttatatcataagaataagtgcaagtattcttgatctaagagacagttttgatgatgctcttcaagtaaatactactgatctgtcaccaaaggaggccaactccaaggaaagctttgcatttaaaccagaaaatatctcagaagaaaatgcaacccacatatttattgccattaaaagtatagataaaagcaatttgacatcaaaagtatccaacattgcacaagtaactttgtttatccctcaagcaaatcctgatgacattgatcctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtagacctagaagagagttttaaaaaacaaaacaatgtaagtaaaggatatttctgaat

SEQ ID NO: 929 - DNA, 254 bp; single-stranded, linear
  immediate source library: COLNNOT05
  immediate source clone: 775019
ggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgttctgcacaatcagagactgtctcgt

SEQ ID NO: 930 - DNA, 236 bp; single-stranded, linear
  immediate source library: COLNNOT05
  immediate source clone: 775384
cacgtgagcgcctcgcctggatgtgagtttcagccagacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaa

SEQ ID NO: 931 - DNA, 619 bp; single-stranded, linear
  immediate source library: COLNNOT05
  immediate source clone: 775437
ttntgtaacgaaaaaacccataatcaagaagctccaagcctacaaaacataaagtgcaattttagaagtacatgggaggtgattagcaattctgaggattttaaaaacaccatacccatggtgacaccacctcctccacctgtcttctcattgctgaagatcagtcaaagaattgtgtgcttagttcttgataagtctggaagcatggggggtaaggaccgcctaaatcgaatgaatcaagcagcaaaacatttcctgctgcagactgttgaaaatggatcctgggtggggatggttcactttgatagtactgccactattgtaaataagctaatccaaataaaaagcagtgatgaaagaaacacactcatggcaggattacctacatatcctctgggaggaacttccatctgctctggaattaaatatgcatttcaggtgattggagagctacattcccaactcgatggatccgaagtactgctgctgactgatggggaggataacactgcaagttcttgtattgatgaagtgaaacaaagtggggccattgttcattttattgctttgggaagagctgctgatgaagcagtaatagagatgagcaagataacaggag

SEQ ID NO: 932 - DNA, 242 bp; single-stranded, linear
  immediate source library: COLNNOT05
  immediate source clone: 775634
gcgcgattcgcggcaggccccgatggaacctcctggtcctgtgagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtg

SEQ ID NO: 933 - DNA, 272 bp; single-stranded, linear
  immediate source library: COLNNOT05
  immediate source clone: 776025
gaacaacaactggcacccgggctgcttccgctgcgagctgtgtgatgtggagctggctgacctgggctttgtgaagaatgccggcaggatctctgccggccttgccacaaccgtgagaaggccaaaggctgggcaagtacatctgccagcggtgccacctggtcatcgacgagcagcccctcatgttcaggagcgacggctaccaccctgaccacttcaactgcacccactgtgggaaggagctgacagccgaggcccgagagctgaagggt

SEQ ID NO: 934 - DNA, 294 bp; single-stranded, linear
  immediate source library: COLNNOT05
  immediate source clone: 777809
aggagctgctgggctggagcggcggcgccgccaatgtccgacagcgagaagctcaacctggacttgatcatcgggcgcctgctggaagtgcagggcttcgnggcctgggnaagaatgtacagctgacagagaacgagatccgngggtctntgcctgaaatnccggggagaatttttcttgaggccagcccatttcttcttggagctagagggcaacccntcaaagatcttggggtgacaanacaacggnccagttactacggaccctttttgcggactattttgagtaatggcg

SEQ ID NO: 935 - DNA, 231 bp; single-stranded, linear
  immediate source library: COLNNOT05
  immediate source clone: 778003
agaggactccaggctcagccaaggagctccggagacctccgnccagaagcccccagcctgcggaggtgtggacccagccctgcccctggagaaacagccgtggtttcatggccccctgaacagggcggatgcagagagccttctgtccctntgcaaggaaggcagctacctagtgcggctnagtgagaccagcccccaggactgctncttgtctntnaggagcagccaggg

SEQ ID NO: 936 - DNA, 245 bp; single-stranded, linear
  immediate source library: COLNNOT05
  immediate source clone: 778511
ctcagccgccaccagctgacccatacgggtgcacgtccctaccaatgcctggactgtggcaagcgcttcacacagagctccaacctgcagcagcaccggcggttgcacttgcggccagtcgcctttgcccgcgccccccgcctccccatcactggtctctacaacaagagtccctactactgcgggacttgtggccgctggttccgcgccatggcgggcttgcgactgcatcagcgggtccatgc

SEQ ID NO: 937 - DNA, 976 bp; single-stranded, linear
  immediate source library: MYOMNOT01
  immediate source clone: 778806
gccttggggctccgggactgtgggctgtctccatccggagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatgtgaaggaggcctgcggggagctgacgggcacagtgtgtgaaccctgccctccaggcacctacattgcccacctcaatggcctaagcaagtgtctgcagtgccaaatgtgtgacccaggacggggaccactgcgccgcgtgccgcgcttacgccacctccagcccgggccagagggtgcagaagggaggcaccgagagtcaggacaccctgtgtcagaactgccccccggggacctttctctcccaatgggaccctggaggaatgtcagcaccagaccaagtgcagctggctggtgacgaaaggccggagcttgggaacaagcagcttcccacttgggtaatggtnggtttcttctcaggggagccttcgttcattcgtcatttgttttgcttccaaagtttgggctaaattcataatgttgttgaaaaaggaaggaaaagcccaaagggggtttgattgntaagttccaanggntgattcggtntttccgtttccaagccnggaaaaaaagacccagggaaggccagaaaaggnttnaagggcccacnagttccantttgaggggcccttgnnaagggccccctttccnggaaacgntttaaccaaanggttttggccccnttggaaagggnggaacaattaaccccttnanttttcacggggggaangnnn

SEQ ID NO: 938 - DNA, 977 bp; single-stranded, linear
  immediate source library: MYOMNOT01
  immediate source clone: 779308
cgcgacagagcgnagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcatcgccataggcaccattgtcatggtgacgggcttcctcggctgcctgggggccatcaaggaaaacaagtgcctcctcctcagctttttcatcgtcctgttggtcaccctcctagcagagctgatcttacccatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacggcaccacgcctttgtggagaacgggctgcwatkaaaaggtgaagatgtggttcgatgacaataagcacgtgcttgggcacggttggggatgtgcatcctcatcatgcaagwtcctggggaatggcttytccatnngacctcttccagaaatccaacggactgtaagaanaagacgcatgacggggttgncggaattccaacccggcctgttgcctttgaaggaaaagnttngcntttttcgctgcttggcnttccaanataccctgaaccaaccccaaagtgcctacccantaactgnttaggctggnttcaagg

SEQ ID NO: 939 - DNA, 271 bp; single-stranded, linear
  immediate source library: MYOMNOT01
  immediate source clone: 779596
atcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatnttcaagtggttctcagaccttactaaacataagagaattcacactggtgagaaaccatacaaatgtgacggatgtgggaaagcctatacacagtcctcacacctcagtgaacacaggaggattcacac

SEQ ID NO: 940 - DNA, 229 bp; single-stranded, linear
  immediate source library: MYOMNOT01
  immediate source clone: 782996
ggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagag

SEQ ID NO: 941 - DNA, 258 bp; single-stranded, linear
  immediate source library: PROSNOT05
  immediate source clone: 785643
gccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcanaccctgaggaaaaaccctgtggaattgtggggtaatgtggggagag

SEQ ID NO: 942 - DNA, 310 bp; single-stranded, linear
  immediate source library: PROSNOT05
  immediate source clone: 787082
cccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggnggctatgagctccagggtagccctgcccgagtatgtcaatccaacctggnttggtctggcacgggagcccanctgtgcagccatgaacgtcaatgtgggtgtcananc

SEQ ID NO: 943 - DNA, 654 bp; single-stranded, linear
  immediate source library: PROSTUT03
  immediate source clone: 791011
tggatagctgccggctccggcttccacttggtcggttgcgcgggagactatggcgtcctcctcgtcccaccagccacggtatcggcggcgacanaggccccggcccaggtttcggcttcgcctccaagaccaagaagaagcacttcgtgcagcagaaggtgaaggtgttccgggcggccgacccgctggtgggtgtgttcctgtggggcgtagcactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccaggtcaggcctctctctagccccattctttccctctcctccctactcacatatagctcagctattgtcagtaatagatgccaactggggagaaaactc

SEQ ID NO: 944 - DNA, 487 bp; single-stranded, linear
  immediate source library: PROSTUT03
  immediate source clone: 791681
tncctccntcagcccctcttnaagggcccccaccgaaagacccccgcatntaggagaaggntcagcgtgaggccaacaaaggngatccnnaagcagcnncagaaggacaagcaggtctaccgggccacgcaccgcctgctgctgctgggtgctggagaatctggtttttngcacctttntgaancagatgaggatcctgcatgttaatgggtttaatggagagggcggcgaanaggacccgcaggctgcaaggagcaacagcgatggtgagaaggctaccnaagtgcnggacatcaaaancaacctgaaagaggcnnttttttttttttttgtcgccatgagcaacctggtgccccccgtggagctggccaaccccganaaccanttcagagtggactacntcctgagtgtgatgaacgtgcctgactttgacttccctcccgaattctatgancatgccaaggctctgtgggaggatganganttn

SEQ ID NO: 945 - DNA, 243 bp; single-stranded, linear
  immediate source library: OVARNOT03
  immediate source clone: 796012
atttaccactgcacagaggagcggctgtacangggncggcggggtcggggcgncttntgcaatggncagcggntncgggtcttcggggagacagatctttnaaaggncttggttctgacagaaattggacccaaacgtgaccctgcgaccctgaagctgttcctgagtaacatggagcggntnctgcatgccaaggcggatggggtccgagtgattgggagnttcacattngcactttgncac

SEQ ID NO: 946 - DNA, 125 bp; single-stranded, linear
  immediate source library: OVARNOT03
  immediate source clone: 796375
ctcaaatctttacattcatcagagagtccacacaggagaaaaaccctataaatgtgaggaatgtggtaaaggctttagtcggccttcaagtcttcaggcccatcagggagttcacactggagaga

SEQ ID NO: 947 - DNA, 195 bp; single-stranded, linear
  immediate source library: BSTMNOT01
  immediate source clone: 805552
gggtcacaggcaccaaggctgggatggggcggcgtgagggcagggctacgacaatggcaccacctgtgcccggcaggcatcaccacggtgctgacgatgaccacgntcatggtcagtgcccgctcctncctgccacgggcatcagccatcaaggcactggacgtctacttctggatctgctatgtcttcgtgttg

SEQ ID NO: 948 - DNA, 487 bp; single-stranded, linear
  immediate source library: STOMNOT02
  immediate source clone: 807267
cngtccntctagcnattgcccacgcntctttcagtcatggcctccggtaacgcgcgcatcggaaagccagcccctgacttcaaggccacagcggtggttgatggcgccttcaaagaggtgaagctgtcggactacaaagggaantacgtggtcctctttttctaccctctggacctcacttttgtgtgccccaccgagatcatcgcgttcagcaaccgtgcanaggacttccgcaagctgggctgtgaantgctgggcgtctcggtggactctcagttcacccacctggcttggatcaacaccccccggaaagagggaggcttgggccccctgaacatccccctgcttgctgacgtgaccagacgcttgtctgaggattacggcgtgcttgaaaacagatgagggcattgcctacaggggcctctttatcatcgatggcaagggttgtccttcgccagatcactgttaatgatttnaaaaaaaaann

SEQ ID NO: 949 - DNA, 297 bp; single-stranded, linear
  immediate source library: LUNGNOT04
  immediate source clone: 810389
gagaaaccgtatgtgtgcagtgagtgtgggaaggccttcaggcgaagttcaaacctcatcaaacaccacagggactnacacaggagagaagccttttgagtgtggcgagtgttggaaagccttnagccagagtgcacanctgaggnagcaccanagggtccacactngagagaagccttatgagtgtaatgattntggcaagcccttcagtcgggtcttcaanctnattaagnaccacagggttnaaantngagagaaggcctataagtgcagtgactttgggaaagcatttngtta

SEQ ID NO: 950 - DNA, 270 bp; single-stranded, linear
  immediate source library: KERANOT02
  immediate source clone: 819550
ctccactgggtccgaatcagtaggtgaccccgcccctgggnttctggaagacctcaccatgggacgnccccgacctngtgcggccaagacgtggntgttcctgctcttgctggggggagcctgggcagagaattttctgacactctcaactgtgcagaagtaaaaatctttccccagaagaagtgtgaggatgcttacccggggcagatcacagatggcatggtctgtgcaggcagcagcaaaggggctgacacgtgccagggcgattnt

SEQ ID NO: 951 - DNA, 248 bp; single-stranded, linear
  immediate source library: KERANOT02
  immediate source clone: 820694
gcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactncctgtcaccagtttatgaatctgggcagcagatgttccagggggtcaaatccatcccccaccctggntactgccaccctggccactctaacgacctcatg

SEQ ID NO: 952 - DNA, 332 bp; single-stranded, linear
  immediate source library: PROSNOT06
  immediate source clone: 824265
atgagggttcagactngagaaaaaccctacaaatataatgaatatggaaaancttttagtgactgctcaggacattttcagagaactcacactggagagaagccctgtgaatgtaatgactgtgggaaacctttcagtttctgttcagccctaattcaacataagagaattcataccagaaagaagccctgactgtaccttcataccagtaaatgcactgactntggaaaagccttcagtgattngttagcacttgttcaacatcagataactcaacactggngaaaaaccgtataaatntactgaatntggaaaagccttcanttngagta

SEQ ID NO: 953 - DNA, 1282 bp; single-stranded, linear
  immediate source library: PROSNOT06
  immediate source clone: 827431
gaagtttctcactagggtcttctctggcccagcctttgactgaagctggtctggagacaggggcattagagaagtgactcatagatggcctaaagaagcggggccactcaaggacccaggacagagggaagagggccaacccagctggaccacaggcaaaccccattgcctttgagagaaagaagaggacccggtgaaacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactntcctttctgggatgacatctcagaatcaggcaaagactttattcggcaccttctggagcgagaccttcagaagaggttcacctgccaacaggccttgcgggacctttggatcttttgggacacaggctttggcagggacatcttagggtttgtcagtgagcagatccggaagaactttgcttggacacactggaagcgagccttcaatgccaccttgttcctgcgccacatccggaagctggggcagatcccagagggcgagggggcctctgagcagggcatggsccgncacagccactnaggccttcgtgctggccagccccccaagtggtgatgcccaggnagatgccgaggccaagtggantganccccagatttncttnc

SEQ ID NO: 954 - DNA, 312 bp; single-stranded, linear
  immediate source library: PROSNOT06
  immediate source clone: 828082
cagnattntcccagggttancanaacttgcatgggtcagcatgtatggcagntcctatgttgcaanctcagttccaatgtgacaggctagagccgcagaactttnatnttacnangggntaggcactctncagtaantgtnttaggtnangggttatgtctnggttggaagagccanngactattcnatnntantntgcttgtggttganaaccacagtcagtagagagatntttggaanccacagtcagtggtgnctgggtggtacccaggctttagcattattgggtgtcaatagcattgtttttgtcat

SEQ ID NO: 955 - DNA, 286 bp; single-stranded, linear
  immediate source library: PROSTUT04
  immediate source clone: 832067
aaatgacagtccatcagacagatctggcccactacccatttttgtatcctgcaagctaagaatggttttatatttctaaatggttgaaagatcaaagaatattgtgacacatgaaaattatatgatattcaaatttcagtgtccataaataaagttttgaaaacatgaatacaaacaaaaaacacctatttatgtttgacctgtggctgtctttgcactaccccagcagagttgagtagttgtagcagacaccacatgcccttgagcctaagatctngcactttac

SEQ ID NO: 956 - DNA, 216 bp; single-stranded, linear
  immediate source library: PROSNOT07
  immediate source clone: 834251
cggagcggaggnaggccggcgacctgcggcgngggagcagccccgacgtgcacgcgctgctggagatcaccgaggagtnggacgccgtgctggtggacaagagcgacaggnctgagccgcccccgctgccacctaccccattcctagctccttacgaacttcctctttcgcattctatatcggcttgagctggctgagatttttctaaattgaaaa

SEQ ID NO: 957 - DNA, 287 bp; single-stranded, linear
  immediate source library: PROSNOT07
  immediate source clone: 835995
tcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacaggaaacaacacaaaataaaacttggtggntaaattatttgta

SEQ ID NO: 958 - DNA, 282 bp; single-stranded, linear
  immediate source library: PROSNOT07
  immediate source clone: 836623
atgggcctctccttggcctctgctgtgctcctggcctccctcctgagtctccaccttggaactgccacacgtgggagtgacatatccaagacctgctgcttccaatacagccacaagccccttccctggacctgggtgcgaagctatgaattcaccagtaacagctgctcccagcgggctgtgatattcactaccaaaagaggcaagaaagtctgtacccatccaaggaaaaaatgggtgcaaaaatacatttctttactgaaaactccgaaacaattgtga

SEQ ID NO: 959 - DNA, 247 bp; single-stranded, linear
  immediate source library: PROSNOT07
  immediate source clone: 837890
cagcgagtgcggcaaggccttcagcaagaactcctcgctcacgcagcaccagcgcatccacaccggcgagaagccctacgagtgctacatctgcaagaagcacttcacggggcgctcgtccctcatcgtgcaccagatcgtgcacaccggggagaagccctacgtgtgcggcgagtgcggcaaggccttcagccagagcgcctacctcatcgagcaccagcggatccanaccggcgagaagccgtac

SEQ ID NO: 960 - DNA, 565 bp; single-stranded, linear
  immediate source library: PROSNOT07
  immediate source clone: 838332
ttgtngccatcncacacaggcggatctgaggttcggcgacccgggacaggacaacgacaggnnacnccgccgagcccgcgttccccccccgcccagagtcatggcggcagcagccgctctgagggcgcctgctcagagcagtgtgacctttgaagatgtggctgtaaacttttccctggaggaatggagtcttcttaatgaggctcagagatgcctgtaccgtgacgtgatgctggagaccttgacacttatatcctccctgggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaagcctacactcctattcatgagagatttcatactgggcaaaagacctatgagtgcagtgagtgtgg

SEQ ID NO: 961 - DNA, 151 bp; single-stranded, linear
  immediate source library: PROSTUT05
  immediate source clone: 839651
cacatccaccagaagtctttctnctgcccagagccagcctgtgggaagtctttcaactttaagaaacacctgaaggagcacatgaagctgcacagtgacacccgggactacatctgtgagttctgcgcccggtctttccgcactagcagca

SEQ ID NO: 962 - DNA, 242 bp; single-stranded, linear
  immediate source library: PROSTUT05
  immediate source clone: 841903
ggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgncatnctcaaggcccttccccag

SEQ ID NO: 963 - DNA, 1001 bp; single-stranded, linear
  immediate source library: PROSTUT05
  immediate source clone: 842889
tcnctccntntnangcaakgggcggggrgcsscgcctggaaacgcgangcaggtyatattgaacattccagatacctatcattactcgatgctgttgataacagcaagatggctttgaactcagggtcaccaccwgctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatctckggacntgtgtgcacctcaaagactaagaaagcactgtgcatcaccttgaccctggggaccttcctcgtgggagctgcgctggccgctggcctactctggaagttcatgggcagcaagtgctccaactctgggatagartgcgactcctcaggtacctgcatcaacccctctaactggtgtgatggcgtgtcacactgccccggcggggaaggacaaraatcggtgttttcgcctctacggaccaaacttcatccttcaggtgtactcatctcagargaagtcctggcaccctgtgtgccaagacnactggaacgagaactacgggcgggcggcctgcagggacatgggctataagaataatttttactctagccaaggaatagtggatgacagcggatcnnccagctttatgaaactgaacacaagtgccggcaatgtcgatatctataaaaaactgtaccacagtgatgcctgttcttcaaaagcagtggtttctttacgctgtatancctgcggggtcaacttgaactcaagccgccagaacaggatcgtgggcggcgaanagcgcgctcccgggggcctggccctggcaggtcagcctgcacgtccagaactccacnttttgcngaagctccatcatcacccccgaattgatcgtgacaccgcccactt

SEQ ID NO: 964 - DNA, 239 bp; single-stranded, linear
  immediate source library: NGANNOT01
  immediate source clone: 850121
gtcgctcagaaccctgggctctgccttcctcaacatcatgtggcctcatgagattgccaatgggaagtggttgctgtacccaatgcaggttgagctggagggcgggcangggcctgggcagaaagggctttgctctcccaggcccaacatcctccacctggatgtggacagtagggataggaggcggcgggagctngagccacctgagcagcaggagcctggtgagcggcaggagccca

SEQ ID NO: 965 - DNA, 229 bp; single-stranded, linear
  immediate source library: NGANNOT01
  immediate source clone: 851571
ggaaaggctttagtgacttctcaggattgcgccaccacgagaaaatccacacaggagagaaaccctataaatgtcctatctgtgagaaagnttcattcagagatcaaactttaatagacatcagagggttcacactggagagaaaccttataaatgttcgcactgtgggaaaagtttcagctggagctcgagccttgacaaacatcaaagatcccacttagggaagaag

SEQ ID NO: 966 - DNA, 246 bp; single-stranded, linear
  immediate source library: NGANNOT01
  immediate source clone: 852401
accacgngtncgcactcagctacgggacacaaacaaagaacagccaccatgcagctcttcctnctcttgtgcctggtgcttctnagccctcanggggcctncnttcancggcancancccngggagatnaagaagagagtcgaggacctccatgtaggtgccacgntggcccccagcagcagnagggactttanctttgacctntacagggccttggntttcgatgcccccagccagaacattttt

SEQ ID NO: 967 - DNA, 257 bp; single-stranded, linear
  immediate source library: NGANNOT01
  immediate source clone: 852708
gcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattcc

SEQ ID NO: 968 - DNA, 248 bp; single-stranded, linear
  immediate source library: NGANNOT01
  immediate source clone: 857279
gccacgggtccggttcancagcatctggggcantgtgttgcaggcataggcgatgttgacgacggccaggtgtgagaggaagaagtacatgggggtgtggagtctggagtncagtgagatgagccccaggatggtcccattncccagcagggtgaagacatagaacagggagaagagcccaaagaggagcatctgaattcttgggcccaggagaaattccagtaggaggaactntttgaccattntct

SEQ ID NO: 969 - DNA, 262 bp; single-stranded, linear
  immediate source library: BRAITUT03
  immediate source clone: 858552
tgcaaccggcgcgaggacacagagcggatcgctgcgntnctncgaacctgnctgcacgnagcctgggtcccagggtctggaggtcgtgcccccaaaaccacagccgaggcctaccacgcgggcatgtgcagccgggaacggcggcgggtacagcgagccttcatgnagggccagttgcgggtggtggtggccacggtggcctttgggntggggctggaccggccagatgtgcgggctgtgntgnatntggggntgnccccaa

SEQ ID NO: 970 - DNA, 255 bp; single-stranded, linear
  immediate source library: BRAITUT03
  immediate source clone: 859876
ggcggggggatatcaatgatggccatgaaatacacctncttnttgggggaactttcatggcttttcatggcatagangtcaacagaggggtcgaattccccaggaccaaagaaccgaggaaagctgaggaggttgccagggctgtccggaggtgtgccataggagcagagtaggttgccacccaccccatcattctnacactnctngtnctntgcccggtcctccacttccatctnctnctgctctgcccggtnc

SEQ ID NO: 971 - DNA, 314 bp; single-stranded, linear
  immediate source library: BRAITUT03
  immediate source clone: 859906
ccctcagtcatctacaccatcaacctggtggtgaccgatctactngtagggctttncctgcccaaggggtttggttgtggtantanggcggccaggggncttgccntncggctgtgnccttcccgcacgtcctcggttacttcctcaacatgcactgtccatcctcttcctcacctgcatctgcgtggaccgctacctggccatcgtgcggcccgaaggctnccgccgntgccgccagcctgcctgtgccagggcgtgtgcgncttcgtgtggctggccgcggtgccgtcaacctgtcggtgctgggcgtgana

SEQ ID NO: 972 - DNA, 274 bp; single-stranded, linear
  immediate source library: BRAITUT03
  immediate source clone: 861034
gtcagttactttgtaacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgnagtccaggncccatccacaggaggaagaagcgacccttccaggcttctggcgcgcaggacagcgggcggtcagtgcacaatgaa

SEQ ID NO: 973 - DNA, 258 bp; single-stranded, linear
  immediate source library: BRAITUT03
  immediate source clone: 862023
ggctgttcagcacatgnaaaacattaagaggtgccaccaatccatacacagaagcaaactacaaaccaacttttctatcagacgatgaattgaaacacctcattctcaggaatgatctgattggtcagagtttgtttgactacctgcatcctaaagatattgccaaagtcaaggagcagctctccttctctgacaccgcaccccgggagcggctcatagatgcaaaaactggacttccagttaaaacagatataaccc

SEQ ID NO: 974 - DNA, 533 bp; single-stranded, linear
  immediate source library: BRAITUT03
  immediate source clone: 862403
gagggaattgtgcctttcgggttccgtnttaagnaaaaacattctcctggccccatggcacgnaccaacaaattnctcctttggttttgctgctttgcctggctgtgttttcctattanccttggttctcaggcttctgggggaaaagctcagattgctgctagtgctgagttggaatntggggctatgccttggtcnttgctgcancatatagatgagaganacaganctggcctccttcccgcgcttttcaaagttctatctgttgggcnaagtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtctgggnaaaaaaa

SEQ ID NO: 975 - DNA, 302 bp; single-stranded, linear
  immediate source library: BRAITUT03
  immediate source clone: 864259
gaactcgtccctgcgcagcatcagagggtgcacaccggtcagaggcccttcagctgtggcatctgcggcaagagcttctcccagcggtcggcccttatcccccatgcccgcagccacgcccgggagaagcccttcaagtgccctgagtgcggcaagcgctttggccagagctcggtgctggccatccacgnccgcacccacctgccaggccgnacctacagctgccccgactgcggcaagaccttcaatcgntcctccactctcatccagcaccagcgntnccacacgggcgagcggcccta

SEQ ID NO: 976 - DNA, 215 bp; single-stranded, linear
  immediate source library: BRAITUT03
  immediate source clone: 864272
atttaccaaaagaacaatacctctataccaaagagcagctcttggataggatgtgtatgactttaggtggtcgagtctctgaagaaatcttctttggaagaattacaactggtgctcaagatgacttgagaaaagtaactcagagtgcatatgcccaagttgctcttctgttgttagaaaaagaagtattagataagaatgatatggttgaactt

SEQ ID NO: 977 - DNA, 286 bp; single-stranded, linear
  immediate source library: BRAITUT03
  immediate source clone: 864414
tttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgc

SEQ ID NO: 978 - DNA, 260 bp; single-stranded, linear
  immediate source library: BRAITUT03
  immediate source clone: 864683
tcttaacattgttaagtttcacaaatattgggctgacattaaagagaacaaggccagggtcatttttatcacagaatacatgtcatctgggagtctgaagcaatttctgaagaagaccaaaaagaaccacaagacgntgaatgaaaaggcatggaagcgttggtgcacacaaatcctctctgccctaagctacctgcactcctgtgacccccccatcatccatgggaacctgacctgtgacaccatcttcatccagcaca

SEQ ID NO: 979 - DNA, 203 bp; single-stranded, linear
  immediate source library: BRAITUT03
  immediate source clone: 865569
aaatgagatttttgttttttttaaatgcaatatctctgtatacagactggntnggncccanccnctgcgtgtggccctnccacagtattttgtgcaatgaagccctgctnccagcctttcagagacagggacaaagcccctatttgggaccctgatcatcaccaganccctgggattggtatngggaagcatgccacagccat

SEQ ID NO: 980 - DNA, 264 bp; single-stranded, linear
  immediate source library: BRAITUT03
  immediate source clone: 866123
tggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaagctggcagattttggcctgtccacatttcagggaggctcacagtcagggacagggtccggggagccagggggcaccctgggtt

SEQ ID NO: 981 - DNA, 255 bp; single-stranded, linear
  immediate source library: BRAITUT03
  immediate source clone: 866390
gccagggaaatggaaagcgagaacagaagagtgataagagaattcatcctccttggtctgacccagtntcaagatattcagctcctggtctttgtgctagttttaatattctacttcatcatcctccctggaaattttctcattattttcaccataaagtcagaccctgggctcacagcccccctctatttctttctgggcaacttggncttnctggatgcatnctactncttcattgtggctccccggatgttg

SEQ ID NO: 982 - DNA, 1337 bp; single-stranded, linear
  immediate source library: LUNGAST01
  immediate source clone: 873352
ctgtaataggagcagtatagggaaacctggtaccctgcaggtactggtccggagttcctgggtcgacccacgcgtccggctttctgtagctgtaacattggtggccacacacctccttacaaagcaactagaacctgcggcatacattggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaagcgatcatctcagtccacattggaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcgctgttcccattccaagaaactctgtcctattgacatgctatgggatagcaacaaatgtaaatgtgttttgcaggaggaaaatccacttgctggaacagaagaccactctcatctccaggaaccagctctctgtgggccacacatgatgtttgacgaagatcgttgcgagtgtgtctgtaaaacaccatgtcccaagatctaatccagcaccccaaaaaatg

SEQ ID NO: 983 - DNA, 257 bp; single-stranded, linear
  immediate source library: LUNGAST01
  immediate source clone: 876063
gcaggagctgcatccagtctctgcacgagcccgtgtcttcattgagctgccactgtccattgcaggaatggccattccccagcaactcttcttctntggtgtggtgaggggcgagagagccatgcagtctgagcgggatgtgggcagcaaggtcaagtatgaggtcacgttttcaaccaaggccattggttaaganccttgggttntnccttcctcaacatcatgtggcctcatgagattncaatggggnngtgttt

SEQ ID NO: 984 - DNA, 300 bp; single-stranded, linear
  immediate source library: LUNGAST01
  immediate source clone: 877555
tctcaatgaaaggcagatgtccctttaaggtttgcttctacagcccgtggactttagcctaaacacggacccgcgaagttgggctttatttgtccatgtctcggacagagcctgggaagctgccagtgagatttcagagaccaagagcgcgaaggggcgggcgatgtggcaatccgtctgggntgtgaaaagcgtggagcgcatttagaggaattcgacgaaaacacaggaaatcactnctnttccgcttctgggcgccgtgccactggggcagaggacttggnaccgcggcancgggat

SEQ ID NO: 985 - DNA, 302 bp; single-stranded, linear
  immediate source library: LUNGAST01
  immediate source clone: 877705
gagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgtggcatctgcgggaagagcttcgggcggggctccaccctgatccagcaccagcgnatncacaccggtgagaagccctacaaatgtgaggtctgcagcaaggccttcttccagagctttgacct

SEQ ID NO: 986 - DNA, 328 bp; single-stranded, linear
  immediate source library: LUNGAST01
  immediate source clone: 877928
ccgaggactcgccccttggcagcagcacccccatggcgtctcctgacctccttccagaggacgtgagggagcacctcgaaggcttgatgctctcgctcttcgagcagagtctgagctgccaggcccaggggggctgcagtaganccgncatggtccctnacagacccacacacgccctacgaggaggagcagcggcagtcagtgcagtctgaccagggctacatctccaggagctccccgcagccccccgagggactcacggaaatggaggangaggaggaagaggagcaggacccagggaagccggccctgccactctctcccgagg

SEQ ID NO: 987 - DNA, 280 bp; single-stranded, linear
  immediate source library: LUNGAST01
  immediate source clone: 878146
aaacatcaatgagagaggtgaaagcggacggagctagcacccccaggttaagagaacaggactgtggtgaacctgcctcgccagcagcatccatctccagactctctggggaacaggtcgacgggaagggnccaggcaggcagtgtatctgaaagtgcgcggagtgaaggaaggattagtccaaagagtgatattactgacactggcctggcacagagcaacaatttgcaggtccccagttttcagaaccaagcagcctcaaaggttccacatctctgct

SEQ ID NO: 988 - DNA, 228 bp; single-stranded, linear
  immediate source library: THYRNOT02
  immediate source clone: 878906
gggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtg

SEQ ID NO: 989 - DNA, 251 bp; single-stranded, linear
  immediate source library: THYRNOT02
  immediate source clone: 881694
gagctgtttgactgtctcacagagaaggtggccctctctgannaggaaaccaggnccatcatgcggtctctgctggnagcgtgagctttctccatgccaacaacnttgtgcatcgaggtctgaagcccnagaatattctcctagatgacagtgtgcagatccgnctttcaggtttcgggttctnctnncacttggaacctngcgagaagcttcgagggttgtgtgggaccccagggtatctagcgncagag

SEQ ID NO: 990 - DNA, 257 bp; single-stranded, linear
  immediate source library: THYRNOT02
  immediate source clone: 881996
ggccgacttccatgccaattgtcgagcctnctaccagacggtcaacagctgccctgcggacaattaccaggngtgtctnggntnttatgctggcatgattgggtttgacatgacaactaactatgtggacttcagccccactggcatcgtggtgttcccctggtgcagctgtcgtggcancgggaacatggaggaggagtntnagaagtttctcagggacttnaacgagaacccatgccttcggaacggcatccagg

SEQ ID NO: 991 - DNA, 221 bp; single-stranded, linear
  immediate source library: THYRNOT02
  immediate source clone: 882035
gccaaggcacagagagattacgaactgaagaaggccgcctatgacatcgaggtcaacacccgccgagcacaggctgacctggcctatnagcttnaggtggccaagactaagcagcagattnaggagcagcgggtgcaggtgcaggtggtggagcgggcccagcaggtggcagtncaggagcaggagatcgcccggngggagaaggagctngaggcccgngt

SEQ ID NO: 992 - DNA, 160 bp; single-stranded, linear
  immediate source library: PANCNOT05
  immediate source clone: 884071
gccatcattggtggggctgtggcctggttaccattgcccttcttgctttagtgtgttggtatgttcataggaatggatcgctcttctcaaggaactgtggcatatagcaaagggaggagaagaaaggatgactatgcagaagctggcactaagaaggaca

SEQ ID NO: 993 - DNA, 982 bp; single-stranded, linear
  immediate source library: STOMTUT01
  immediate source clone: 889096
tttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatycagtttatscgccagaagggacgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggntggccccatatcgnnttttcctcnncnatactncngngatttg

SEQ ID NO: 994 - DNA, 654 bp; single-stranded, linear
  immediate source library: STOMTUT01
  immediate source clone: 889949
tccacctccaacgagccatgttccaggctgcaggagccgcccaggccaccccctctcatgacgccaaaggggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccnncctgcttcctgcttcgttcagcctccctcccca

SEQ ID NO: 995 - DNA, 347 bp; single-stranded, linear
  immediate source library: BRSTNOT05
  immediate source clone: 896136
catggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgntctttaacatgaatgcgatgagtgccttataccacattgcacagaacgaatcccccgtgctccagtcaggacactggtctgagtacttncggaattttgtcgactcctgtcttcagaaaatccctcaagacagaccaacctnagaggttcttctgaagcaccgtttgtgcttcgggagcggccanccacagtcatcag

SEQ ID NO: 996 - DNA, 1346 bp; single-stranded, linear
  immediate source library: BRSTNOT05
  immediate source clone: 897147
cagacctccgccacatcctccacctctcttggtccagcgagcgttgccgggccagggtcaagcggagggctccgacggcgcggacggagcgaacgncgagccatggcgcaccaaacgggcatccacgccacggaagagctgaaggaattctttgccaaggcacgggctggctctgtgcggctcatcaaggttgtgattgaggacgancagctcgtgctgggtgcctcgcaggagccattnggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgcccttccgggtgccccgagatgctgcccgntaccacttnttcctctacaagcacaaccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaattgagattggcgatggggcagagctgacggcagagttcctctacgacgaggtgcaccccaagcaacacgccttcaagcaggccttcgccaagcccaagggcccagggggcaagcggggccataagcgcctnatcacgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacctgttccctgttgctgtccctgcat

SEQ ID NO: 997 - DNA, 273 bp; single-stranded, linear
  immediate source library: BRSTTUT03
  immediate source clone: 898537
tgggctgcagtgtggcaaaggcctggaggacaggggtgaagctgtctgtgggtcagagtgaggaggggccttcactgcaatgctgttgccacccccaggcctccggaatgccccccgctgctgggcagtgatccagcccctgctgtgtgccgtatacatgcccaagtgtgagaatgaccgggtggagctgcccagccgtaccctctgccaggncacccgaggcccctgtgccatcgtggagagggagcggggctggcctgacttcctgcgctg

SEQ ID NO: 998 - DNA, 283 bp; single-stranded, linear
  immediate source library: BRSTTUT03
  immediate source clone: 898651
gtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattggaccttttggttttgcaaaactttgcttgtgtgca

SEQ ID NO: 999 - DNA, 220 bp; single-stranded, linear
  immediate source library: BRSTTUT03
  immediate source clone: 899024
agaaaggccaccacagctcagaaggtgcagcagatgaaacagaggctaaatgagaatgaacgaaaaagaaaaagttttccccattttaaaaagaaaagcaaacaaagaaacaaaagtttttcctaaaaatatctttgaaggaaaattctccttactgggatagtcaggccaagattgacagacacctaatattcatgacttgagaatattctgcagctat

SEQ ID NO: 1000 - DNA, 330 bp; single-stranded, linear
  immediate source library: BRSTTUT03
  immediate source clone: 899043
aanntnccccatcataacagagcatgtgacctttgaagacgtggctgtaaacttttccctggaggaatgragtcttcttaatgaggctcagggatgcctgtaccatgatgtgatgctggagaccttgacacttatatcctccctggtaaggtactcatacttaactgtgacctgagttagtctctgcccctcccctttattcctcttggtaataacgkctttctcacatcaggactgtggcacagcttcattctccaattctctggatcagttctgtggttggtagtactgagatacatgtactgccctctcctttccttgagcagcccc

SEQ ID NO: 1001 - DNA, 154 bp; single-stranded, linear
  immediate source library: BRSTTUT03
  immediate source clone: 902631
accatataaaggctttgtcacgttttatacatttctagggtttcacactagtataacttttttttttaatgtattgcaaagttggaggtgtttgtacaagtactgtcacatctttcaggtttgtagagttccttttcagcatgaattatcgttt

SEQ ID NO: 1002 - DNA, 285 bp; single-stranded, linear
  immediate source library: COLNNOT08
  immediate source clone: 907157
ccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatcttcaaccggt

SEQ ID NO: 1003 - DNA, 311 bp; single-stranded, linear
  immediate source library: BRSTNOT04
  immediate source clone: 915403
tgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacanagattacaacgggttcttcctcagcaggcacacaaagcagtacctcaaatcgtttgtgggctgaggatagtactgagaaagaaaaggacagtgttcctacggcagtgaccattctgttgctccaactgttgt

SEQ ID NO: 1004 - DNA, 335 bp; single-stranded, linear
  immediate source library: BRSTNOT04
  immediate source clone: 917525
gtacagccacacaagntaacctcaacaaagntagcatgctactggntagcattttaactnccagcattgaagcagataagaagattcttaaacagcaagccccnnccaacacggactggcgtttntctcaggnccagagacccggcaccagcgggttccaaaatggcgatgacaacggcaactgggcccaacaaccagtttggcacagagatgctgcaagccatgatcttngcgttcgncagtgaagctgctgatgggagnttcaccntgggagggagtgccggcaccatgggattgagcgnccgtacggaccccaattnaacntgcagcacgtg

SEQ ID NO: 1005 - DNA, 372 bp; single-stranded, linear
  immediate source library: BRAINOT04
  immediate source clone: 924579
gcccggccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggntgcggcaacttcggggagctncgcctaggaaagaatctntatacaaatgattacgtggctatcaaattggagccgatcaagtnccgggcccng

SEQ ID NO: 1006 - DNA, 309 bp; single-stranded, linear
  immediate source library: BRAINOT04
  immediate source clone: 924778
aatggcctcaccatcgactatgccgggcgccgtatgtactgggtggatgctaagcaccatgtcatcgagagggccaatctggatgggagtcaccgtaaggctgtcattagccagggcctnccgnatcccttcggcatcacagtgtttgaagacagcctgtactggacagactggcacaccaagagcatcaatagcgctaacaaatttacggggaagaaccaggnaatcattcgcaacaaactccacttccctatggacatccacaccttgcacccccagcggcaacctgcagggaaaaaccgctgtggg

SEQ ID NO: 1007 - DNA, 308 bp; single-stranded, linear
  immediate source library: BRAINOT04
  immediate source clone: 926018
ggngggacttccagtccttcgtcaaagactgccttactaaagatcacaggaagagaccaaagtataataagctacttgaacacagcttcatcaaganctacgagacgctggaggtggacgtggcgtcctggttcaaggatgtcatggcgaagactgagtcacctnggactagcggcgtcctgagccagccccacctgcccttnttcaggtagctgnttggnggtggncagncccacagggggccaggggnatggncataggcctttncnnatttgggcaannagttgttnnaggggagattgggattg

SEQ ID NO: 1008 - DNA, 288 bp; single-stranded, linear
  immediate source library: BRAINOT04
  immediate source clone: 926034
gtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaatggtcaaccaagggcccgtgatggaagtgcccacccttaaaccantttttgaagaccagggccgtt

SEQ ID NO: 1009 - DNA, 346 bp; single-stranded, linear
  immediate source library: BRAINOT04
  immediate source clone: 926250
ccgaaaaacaggagttttgacagcctccagagtatttgacagagaagaacaagaacgattcatttttacagtaactgccagggacaatgggacccctcccctccaaagccaagcggctgtgattgttactgttctggatgagaatgacaatagccccaantttanttcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtcttcat

SEQ ID NO: 1010 - DNA, 270 bp; single-stranded, linear
  immediate source library: BRAINOT04
  immediate source clone: 926642
aacaaattgttcatagtaaataatcaccaccgtatggattttccaagtgttccattaaaaccaggatgtagagcaccaaaagatcaggaccacgggaggagcagcctcctccacctttactaaggcacaacctggcattgtatgcaatttagtacttcagagtaaaaacctgcatgcccaatgttatgcaaagcgattctagcatgaaataaattttgtatcatggtttctgtatagtctaaagcagatttgttttcctgaagcagtcgg

SEQ ID NO: 1011 - DNA, 678 bp; single-stranded, linear
  immediate source library: BRAINOT04
  immediate source clone: 927003
cntnnctncgtcttgggnntcctncntcannnagcttcgtgaagncgctcttanacccatancncnctgttcttcgtgcccttcgtgtgctggatcgtgtgcaccgtnctgcgccagcaactggagctcggtcgggacctgtcgcgcacgtccaaggaccaccacgtcagtgtacctgcttttcatcaccannnttctgagctcggctccggtagccgacgggccccggttgcagggcgacctgcgcaatctgtgccgcctggcccgcgagggcgtcctcggacgcagggcgcantttgccgagaaggaactggagcaactggagcttcgtggctccaaagtgcagacgctgtttctcancaaaaaggactgccgggcgtgctggaaacagaggtcacctaccagttcatcggaccagagcttcnaggaattcctccgcggcactgtcctacctgctggaagacggnggggtgcccatgaccgccgctggcggcgtttgggacactcctgctttgggacgcccaccgcacagccacttggtgctcacacccgcttcctcttccgactgctgaangntgagcgaagcgnnacatcnacccccattccgctgcatggtttccaacntttttaaccagaagccctgcggtgggtttcaggaacaggantngctnccccgaa

SEQ ID NO: 1012 - DNA, 244 bp; single-stranded, linear
  immediate source library: BRAINOT04
  immediate source clone: 927740
tcanggccagccagttcttcaattcttacagtccctttccatgtcattaaagaactcacactggagagaaatcttatcaatgttagaattgtggtaaagctctctgttgttcccatttacatgaaagatgtgnacagtcaaattgtgggnaaaatctttngggtttgggannttnggacccatttttttttttnnggggncaaaaanccnttngnattccnagggggggancctttttaaagga

SEQ ID NO: 1013 - DNA, 378 bp; single-stranded, linear
  immediate source library: BRAINOT04
  immediate source clone: 928085
cttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaa

SEQ ID NO: 1014 - DNA, 223 bp; single-stranded, linear
  immediate source library: BRAINOT04
  immediate source clone: 928596
atctgaccccttcgtncgagtgcgctacaagggccggacacgggagacctngatcgtgaagaagtcatgctacccacgntggaatgagacgtttgaatttgagctgcangagggggccatggaggcgntgtgcgtggaggcctgggactgggaccttgtcagccgaaacgacttctgggcaaagtggtgattgatgtttccagagactgcgggtggtgcagca

SEQ ID NO: 1015 - DNA, 282 bp; single-stranded, linear
  immediate source library: BRAINOT04
  immediate source clone: 928762
gnatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagat

SEQ ID NO: 1016 - DNA, 286 bp; single-stranded, linear
  immediate source library: BRAINOT04
  immediate source clone: 929130
ggtgctcaagggtggcaccgtgctngccatgctagggaagggcgacctgatcggctgtgagctgccccggcgggagcaggtggtaaaggccaatgccgacgtgaaggggctgacgtactgcgtnctgcagtgtntgcagctggntggcctgcacgacagccttgcgctgtaccccgagtttgccccgngcttnagtngtggcctncgaggggagctcagctacaacctgggtgctgggggaggctntgcagaggtggacaccagntncctgagcggcgacaatacc

SEQ ID NO: 1017 - DNA, 659 bp; single-stranded, linear
  immediate source library: CERVNOT01
  immediate source clone: 930839
ncacnggtnggaattgggccccctgcaaaattcctcgttttgttcctgcgcaacttcagtntcccttcgnnaccccatttacatntattggagaccagaccagaagcccttctgaattaagatctcacattcttgaaggtggcattgaatntcactaagatcggaagatgagtgancttgaccagttncggcaggaggccgagcaacttnagaaccagattcganacgccaggaaagcntgtgcngatgcnactctctctcagatcacaaacaacatcgaccctttttgnntntttttttgcgcacgaggaggacactgcgggggcacctggccaagatctncgccntgcactggggcacagactccaggcttctcgtcagtgcctcgcaggatggtaaacttatcntctgggacagctacgccaccnacaaggtcctcgccatccctctgcgctcctcctgggtcatgacctgtgcatntgccccttctgggaactatgtggcctgcggtggcctggataacatttgctccatttacaatctgaaaactcgtnaggggaacntgcgcntgagtcctnagctggcanggacacacnnggttanctngtccttgctgcccgattcctngggatgaanaattcanantcngtctcccaagc

SEQ ID NO: 1018 - DNA, 278 bp; single-stranded, linear
  immediate source library: CERVNOT01
  immediate source clone: 932340
ctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagag

SEQ ID NO: 1019 - DNA, 889 bp; single-stranded, linear
  immediate source library: CERVNOT01
  immediate source clone: 933230
tttttnnctnnnnnggccntttttaanagttgtctcntttngnnacgcattgggaaatgggcnccnttcataanctcccanttttaactgcctcccctcctgagggtccccagagctnccaaccctataaagggtgaggaagaagaagaggagctggtatntcccccagcctatgggctggnncntggtggcgggttcncgctgtccccanaggagctgggctcanatgaggatgccatcgatcctgacctgatggcctacctaanctcnctgcaccaggacaacctggcaccaggcctggacagccaanacaagctggtgcgcaaactnttttncttttttttttnnngagtgccctgtctgccacaagatcatccatggggcaggcaaactgcctcnccacatgaggacccacacaggcgagaagccctttgcctgcgangtctgcggtgttcnattcaccangaacgacnagctgaagatccacttgcggaagcncacgggagancgcccctactcatgccngcactgctcagcccgcttcttgcacagctacaactcaagaaccacntgcacctgcacacangggaacggccctatnaattgccaccttgtgccanaagggttttcgccaaaggaaggaccacctgcnancggccaccttnnaaanggccaaaanattggccttngaaagtttcggcaccccaaangggcncncnncnaangggaatnantnntnnnnacccccnattttncncggccancctttttaacgggtttgttggtnttccccccncttgggccttcnaaacntcttccaattgggccncctttggaaaacttttccgncttctttttttaancttccaattcttgggnaacnatnccc

SEQ ID NO: 1020 - DNA, 291 bp; single-stranded, linear
  immediate source library: CERVNOT01
  immediate source clone: 934370
gtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctgggggacagctggaccgcgttggaaggtgcagaggataaggaggcactgctgattgaagac

SEQ ID NO: 1021 - DNA, 341 bp; single-stranded, linear
  immediate source library: CERVNOT01
  immediate source clone: 937019
atccaggccaagaccacaggctatgacacgnactgctacatnttgaacctggccattgccgacctgtgggttgtnctnaccatnccagtntgggtggtcagtntngtgcagcacaaccagtggcccatgggcgagntnacgtgcaaagtcacacagctcatgttgtgcntnaacctgttgggcagcattttgttctnacgtgcatgagcgtggnccggtacctgtgcntgagctgcttnancaacagccccagcagcaggaagaagtggtacgccgtgtcgtgttgcatcctggtgttggttgttggctttttgggtgtttttgcctgaaacttgttactg

SEQ ID NO: 1022 - DNA, 676 bp; single-stranded, linear
  immediate source library: CERVNOT01
  immediate source clone: 937525
acgtgcttcctcctngaancaatgatcgatnggcccncaaaaaaancctgggcnntagagcagaggaggcagtgaccttcaaggatgtggcngtgatcttcactgaggaggagctggggctgctggaccctgcccagaggaagctgtaccgagatgtgatgcttganaacttcaggaacctgctctcagtggggcatcaaccattccatggagatactttccacttcctaagggaagaaaagttttgggtgatggggacaacaagccaaagagaagggaatttgggaggcgagatccaaactgatnttnnnactgttccagaagcaggaacacatgaagaattttcctgcaagcaaatttgggaacaaattgcaagtgacttaaccgggtctcaagataccaccataagtaactctcagttatttgaacaagatgacaacccctcccagattaaagcaagactatctacagttcacacaagaaaaaaacctttccagggtgaaaattgtaaacagttcttcagtgatgtttccttctttgatcttcctcancagttntnttcaggaganaatctcataccttgatgagtgtggaaaaagcttctgttacttctcacccctcatattcatcagaggtccacatgggaattgaaatgctataatnttgattttntttt

SEQ ID NO: 1023 - DNA, 288 bp; single-stranded, linear
  immediate source library: CERVNOT01
  immediate source clone: 938735
gccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaaganacaagaaaactaagaaatccgagcggttggagggggagtctgtgtggatgggatggggacgccgggggagggtttgt

SEQ ID NO: 1024 - DNA, 325 bp; single-stranded, linear
  immediate source library: CERVNOT01
  immediate source clone: 939088
atgaagtccagcggnctcttncccttnctggtgctgcttgccctgggaactctggcaccttgggctgtggaaggctctggaaagtccttcaaagctggagtctgtccctccaaggaaatctgcccagtgcttagatacaaagaaacctgagtgccagagtgactggcagtgtccagggaagaagagatgttgtcctgacacttgtggcatcaaatgcctggatcctnttgacacccaaacccaacaaggaggaagctgggaagtgnccagtgacttatggncaatgtttgatgttaanccccccaattttgtgagatggtggcca

SEQ ID NO: 1025 - DNA, 276 bp; single-stranded, linear
  immediate source library: ADRENOT03
  immediate source clone: 939531
cctgagccttccagtcccaacgccgcggtccctgaagccatccctacgccccgagctgcggcctccgcggccctggagctgcctctngggcccgcacccgtgagcgtaggnctcaggccgaagctgaagcgcgctccacaccaggncccgccggctctagactcggtcccgagacgttccgccagcgtttccggcagttccgctaccaggatgcggcgggtccccgggaggntttncggcagctgcgggagctgtcccgccagtggctgcggcctg

SEQ ID NO: 1026 - DNA, 298 bp; single-stranded, linear
  immediate source library: RATRNOT02
  immediate source clone: 947336
gcgggcagagatccacttcctgaagcaaggntgtggtgaagacaagatctgccagagcaatntgcagctggtccacgaccgnttctgcacccgggtcagcgacacggaattccaacctntgcccatggatgtggatggaacaacagccctgtttgcactgagtgggcagccagtcattggnctggagntgatggtcaccaacctgccatnggacccagnccagccccagggtnatggggtgatgcccatgaaggccagttctggtcatgtttctgattagtnnactattaggggtncg

SEQ ID NO: 1027 - DNA, 499 bp; single-stranded, linear
  immediate source library: PANCNOT05
  immediate source clone: 949299
gaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagta

SEQ ID NO: 1028 - DNA, 240 bp; single-stranded, linear
  immediate source library: KIDNNOT05
  immediate source clone: 954226
aaggcgcccaccaagaagagccccctgagcggggtcagccagggaggggaagcaggtccagcgcaacgncgccaacgcgcgagagcggggcccgcatgcgagtgctgagcaaggccttctccagactcaagaccaccctgccctgggtgccccccgacaccaagctctccaagctggacacgctcaggctggcgtccagntacatngcccacttgaggcagatcctggctaacgacaaat

SEQ ID NO: 1029 - DNA, 682 bp; single-stranded, linear
  immediate source library: KIDNNOT05
  immediate source clone: 956818
cagagcatcgatcttaaccataattttgctgacctcaacacaccactgtgggaagcacaggacgatgggaaggtgccccacatcgtccccaaccatcacctgccattgcccacttactacaccctgcccaatgccaccgtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcamgsccacaccagatgatgctgtgtttcgctggctcagcactgtctatgctggcagtaatctggccatgcaggacaaccagccgccgaccctgccacagccaggacttctccgtgcacggcaacatcatcaacggggctgactggcacaacggtccccggggagcatgaatgacttcagctacctacacaccaactgctttgaggtcaattttggaagcttttcctttgacaagtttcccttcaacggngaattgaattgcccccagggagtggggagaaccaaccaaaaggacgnccttncttnaccttacctggggccaggtgcgcatggggcattgcaggagtggtgagggacaaggacacggagctttgggattgctgacggtgttcattgccgtggatngg

SEQ ID NO: 1030 - DNA, 310 bp; single-stranded, linear
  immediate source library: BRSTTUT03
  immediate source clone: 959745
gtgatgagcgcacgggctgcggagacgcaccggagcgntngcccagccgccggctccaagcccctgaggtttccggggaccacaatgaacaagttgctgtgctgcgcgntcgtgtttctggacatctccattaagtggaccacccaggaaacgtttcctccaaagtaccttcattatgacgaagaaacctntcatcagctgttgtgtgacaaatgtcctcctggtacctacctaaaacaacantgtacagcaaagtggaagaccgtgtgcggcccttgncctgaccantantacacagacagctggcaca

SEQ ID NO: 1031 - DNA, 318 bp; single-stranded, linear
  immediate source library: BRSTTUT03
  immediate source clone: 961450
taacatggcccggncacaggatggttatcgtatagtccagcacctncagtacattggntggnctgcctaccgggacacgnccccctccaagcgntntntgctcaaagtggtccgacgactggagaagtggcaggagcagtatgacgggagggagggacgtactgtggtccactgnctaaatgggggaggccgtagtggaaccttctgtgccatctgcagtgtgtgtgagatgatccagcagcaaaacatcattgacgtgttccacatcgtgaaaacactgcgtaacaacaaatncaacatggtggagacctggaggtt

SEQ ID NO: 1032 - DNA, 293 bp; single-stranded, linear
  immediate source library: BRSTNOT05
  immediate source clone: 965175
gcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtg

SEQ ID NO: 1033 - DNA, 840 bp; single-stranded, linear
  immediate source library: BRSTNOT05
  immediate source clone: 965517
aaaccttcacctctcatgctgaagctcacacccttgccctccaagatgaaggtttctgcagcgcttctgtgcctgctgctcatggcagccactttcagccctcagggacttgctcagccagattcagtttccattccaatcacctgctgctttaacgtgatcaataggaaaattcctatccagaggctggagagctacacaagaatcaccaacatccaatgtcccaaggaagctgtgatcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagaaaagcttatttattttccccaacctcccccaggtgcagtgtgacattattttattataacatccacaaagagattatttttaaataatttaaagcataatatttcttaaaaagtatttaattatatttaagttgttgatgttttaactctatctgtcatacatcctagtgaatgtaaaatgcaaaatcctggtgatgtgttttttgtttttgttttcctgtgagctcaactaagttcacggccaaangtcattgttctccctcctaccngtncgtagtgttgtggggtcctcccntggatcatcaaggtgaaacacttaggtattctttggcaatcagtgctcctgtaagtcaaatgtgtgctttgtactgctgttgttgaaattgangttactgtanataactatggaattttgaaaaaaaatttcaaaaagaaaaanatatatataatttaaaacta

SEQ ID NO: 1034 - DNA, 884 bp; single-stranded, linear
  immediate source library: BRSTNOT05
  immediate source clone: 966470
aagggcncgaaaggacctgtgganaagggcctggtgttntggggcccggtgtttgggaccggagggtgttgacggctgatgagttccttgggtttgctctttcttcacctgaaaagaanactccaggaagggcagcacatgccggagaaagatgaattccagcttgaccgcccagaggcgcggcagtgacgccganttgggaccctgggtgatggctgcgaggtccaaggacgcggcgccgtcccaacgcgacngacttttgcccgtgaaagtggaggaagactcncccggaagttgggagcccaactatcccgcggcttctccngaccccgaaacttctcgactgcactttaggcagctgcgttaccaggaggtggctggaccggaagagcgctgagccggctccganaactctgtcgtcggtggctganacccnagctgctctccaaggagcagatcctggagctgctggtgctggancanttcctcaccaccctgcccgaagagcttcaagcctgggtgcganagcactgcccanaaaaccgggaagaagccgtggccntggtnccggctctgcaccaancgctcgatggaactcctcccnggggatggtgactttcgaagacccggtgtntctctaaccttgggaagaattggaacccctggnacccnccncngganggacntctgcnaaaaaaaatncccnnaaaagaatcccgggancnccatttccccccaattttggaaaaccccaaattggaaaaaacnaanaatttgaattcccantgcccccnanttttanaaaaaaaccggaacccccngggggcnacttnccaaaancctttccagggggaaaccccccccngtttttcntaattnttggc

SEQ ID NO: 1035 - DNA, 228 bp; single-stranded, linear
  immediate source library: BRSTNOT05
  immediate source clone: 968129
tgctgacccatgatggcagggtgaagctgtcagactttgggttctgcgcccaggtgagcaaggaagtgccccgaaggaagtcgctggtcggcacgccctactggatggccccagagctcatntcccgccttccctacgggccagaggtagacatctggtcgctggggataatggtgattgagatggtggacggagagcccccctacttcaacgagccacccctcaaag

SEQ ID NO: 1036 - DNA, 602 bp; single-stranded, linear
  immediate source library: BRSTNOT05
  immediate source clone: 968249
ntccnncanaagaggcctgagaaggaagaaactatggcntccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccagaatgcccagatccaggccctatatgctgaagatggaagcctgagtgcagatgcccccagtgagcaggtccaacagcagggcaagcatccaggtgaccctgaggccgcgcgccagaagttccggcagttccttataaggacatgacaggtccccgggaggccctggaccagctccgagagctgttccgnaaaaaaaaa

SEQ ID NO: 1037 - DNA, 243 bp; single-stranded, linear
  immediate source library: MUSCNOT02
  immediate source clone: 971090
gtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggc

SEQ ID NO: 1038 - DNA, 294 bp; single-stranded, linear
  immediate source library: MUSCNOT02
  immediate source clone: 975377
gcccatttggagggaactgtttttacaagcatgcgtaccctgatggccgtagagaggagccacagagacagaaagtgggaacatcaagcagataccgggcccaacgaaggaaccactnntgggaactcattgaggaaagagagaacagcaacccctttgacaacgatgaagaagaggttgtcacctttgagctgggcgagatgttgcttatgcttttggctgcaggtggggacgacgaactaacagactntgaagatgagtgggacttgtttcatgatgagctggaagattttt

SEQ ID NO: 1039 - DNA, 289 bp; single-stranded, linear
  immediate source library: TONGTUT01
  immediate source clone: 980625
aggatctggacctnatgctnctggacgactnactgntaccgtggcctntgatccacttntgtccaccatgtcccccgaggnctccaaggccagcagccgccggagcagcttcagcatggaggagggcgatgtgctgtgaccctggntgcccctgtgccagggaacaggggccggcctgggggntnggagggccaggggcaactncctcccacccttcaggctgcactgtgtgtgaagtagccaactgccctgcctacntctnccngttggacnctgtttgganttagtg

SEQ ID NO: 1040 - DNA, 197 bp; single-stranded, linear
  immediate source library: TONGTUT01
  immediate source clone: 980996
gctgcggccatcgggtggatgccggtggccaactgccccatgcccctggccccggccgacaagaacaagcggcaggatgagctgattgtcctcaacgtgagtgggcggaggttccagacctggaggaccacgttggggcgttaaccggaaaacnttttttgggaaaaaagggggaaagggtttttttttaaaggggg

SEQ ID NO: 1041 - DNA, 270 bp; single-stranded, linear
  immediate source library: TONGTUT01
  immediate source clone: 983688
ggctatcangngcntnaaggtggncttanccctggnctttnatntatccaacaaccacatatactggacagacgtnagcctgaagaccatnagccgngacttnatgaacgggagntngatggagcacgtggtggagttttgccttnactaccccgagggcatggccgttgacttgatgggcaagaacctctantnggnccacaattggaccaacagatttgaagtggcgcggctggacgggcagtttcgncaagtnctctgtggagggat

SEQ ID NO: 1042 - DNA, 318 bp; single-stranded, linear
  immediate source library: LVENNOT03
  immediate source clone: 985852
accagtcctgtccctnggcgncgacgtgctgcctgagtacaagctgcaggcaccgngcatncaccgntggaccattctgcattacagaccctttcaaggccgtgtgggactggcttatactgctgctggtcattacacgggtgttttcacancctanttggntggcttcntgntgaaggganggaagaagnnccntttnttacgagtgtnggntangnttgcaanncgntggnttggtggacctaatngtggacataangttaatgagggcatttattnaatnncgaananttnggtaatggnaanggggnggtggta

SEQ ID NO: 1043 - DNA, 331 bp; single-stranded, linear
  immediate source library: LVENNOT03
  immediate source clone: 987281
ctctgataaaggagaagtggctgaatgaggacatcatgctcaggaccctcaaggtcacattccagaaggagtcccgttctgtgtaccagctacagtatatgtnctggccagaccgtggggtccccagcagtnctgaccacatgctcgccatggtggaggaagcccgtngncttcagggatctggccctgaacccctntgtgtccactgcagtgcgggttgtgggcgaacaggcgtcctgtgcaccgtggattatgtgaggcagctgctcctgacccagatgatcccacctgacttcagtntntttgatgtggtccttaagatgaggaagca

SEQ ID NO: 1044 - DNA, 305 bp; single-stranded, linear
  immediate source library: LVENNOT03
  immediate source clone: 988284
ggactntngtcggacccnacgcccagcggccctgcgtcttcccaggtgaccacgncggcttcaggacatgcacggacacagncgcaacggccaggtccacgtgccccggcggaagcgncgcaaccggttcgtcaagaagaacggncaatgcaacgtgtacttcgccaacctgagcaacaagtcgcagcgctacatngcgcgacatnttnagcagctgcggttggacangggctnggggntacatgnttcatgatctttnttcgngggcttgcntgnctncngggttntntttgggggttntgttt

SEQ ID NO: 1045 - DNA, 534 bp; single-stranded, linear
  immediate source library: KIDNTUT01
  immediate source clone: 995413
ggnnccncaaccaaaantanatcctttttcccagtcaccctctggcatccaggcccagaataccntgagccctgnacttaagttcccaacccaggaccgaatttccaaggatagccagccacttggcccattgcttcaggatggcgacgtngatgaggaatgcccggcccaggcacanatgccacctgaacttcagagcaattcggctacccancaggacccagatggcagtggagccagtttctcatcttctgccaggggcacccanccgcatggctacctggccaagaagttacacanccccattgatnnttntttntccaaagcaaagaccccagagcctggagcccagcagtctggcttccctacactctcgcggagccctcctggcccagcaggaagctccccaaagcaggggcgacggtaccggtgtggagagtgtggcaaggcattcctacagctgtgccaccnaaagaagcacgcatttgtgcacacgggccacaagccctttcttgcactnaaatgtgananatt

SEQ ID NO: 1046 - DNA, 653 bp; single-stranded, linear
  immediate source library: KIDNTUT01
  immediate source clone: 997190
gttagcagagcacggaccagtgtctccggagaatgctattctcctacatttccgaacaggttatcaacgcacagatcgatcactgcctctgtcccatcgctccctgaagtagctctgactccggttccttgaaaggggcgtgtacagaagtaaagatggagcctgcaggggagcgctttcccgaacaaaggcaagtcctgattctccttcttttactggaagtgaccctggcaggctgggaaccccgtcgctattctgtgatggaggaaacagagagaggttcttttgtagccaacctggccaatgacctagggctgggagtgggggagctagccgagcggggagcccgggtagtttctgaggataacgaacaaggcttgcagcttgatctgcagaccgggcagttgatattaaatgagaagctggaccgggagaagctgtgtggccctactgagccctgtataatgcatttccaagcgtcactgaaaaaacctttggaagtatttcgagctgaactactagtgncagagcataaacgatcattctcctgagtttcctgaaagagaaatgaccctgaaaantcccagaanctagctccttgggactgtgtttcctctganaaaagctcgggactnggacgtgggnagcaatat

SEQ ID NO: 1047 - DNA, 234 bp; single-stranded, linear
  immediate source library: KIDNTUT01
  immediate source clone: 998550
ctttcaggcattgacatcctcatctccacctcatccatgcccaaaatgctggccatcttctggttcaattccactaccatccagtttgatgcttgtctgctacagatgtttgccatccactccttatctggcatggaatccacagtgctgctggccatggnttttgaccgntatgtggccatctgtcacccactgngncatgccacagtanttangtngcctgngtgacaaatt

SEQ ID NO: 1048 - DNA, 238 bp; single-stranded, linear
  immediate source library: KIDNTUT01
  immediate source clone: 999192
aggagatgaagccacagcgcgacaagctctgaggaggctgagaggccacacggacatggaggccgagctggaggacatgcgtgcggaggcccgggccgagcgcgccgagggccacctgtctgtgctgcacctctgtgccctgcggtccctgcgctggcagctcctctccatcatcgtgctcatggccggccagcagctgtcgggcatcaatgcgatcaactactatgcggacaccatc

SEQ ID NO: 1049 - DNA, 235 bp; single-stranded, linear
  immediate source library: KIDNTUT01
  immediate source clone: 999335
tgngccgctgcccctacgnctcagcccagctcgtcaacctgacacgacatacccgnacccacactggcgagaagccctaccgctgtccccactgcccctttgcctgcagcagcctgggcaacctgaggcggcatcagcgtacccacgcagggccccccactcctncctgcccgacctgtggcttccgctgctgtactccacgaccagcccggcctnccagtcccacagagcagga

SEQ ID NO: 1050 - DNA, 3120 bp; single-stranded, linear
  immediate source library: GENBANK
  immediate source clone: g1000887
ccgcagagggccggggctacggggcagccccgggcgatgaggggccggcgttgaccgggaagagcgggcaccgcggcagtggctccgaggggacccgcgatggcagcgccctgagaggaggctccaggcagggcgggctgcgctggcagcggccgctgaggtgctggccggccggctggctggcgacgggggcagaagcgacgagaggcgcgctcggcacccgcacccccgtgcccccgcctcagttgtctaaacttcgggctctcttccaccgtctgcgcgcccagagtcaacaacttcttcacccccctccgcccccgcccttccctccgtcagccccgggagctcgccgcggcccggggaccaggaacctccagcgctgagatgtggccgtgaggcgttggcgggcgccgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttg

SEQ ID NO: 1051 - DNA, 1535 bp; single-stranded, linear
  immediate source library: GENBANK
  immediate source clone: g1002738
gcgagtgctttcccgctctccaaaccccactcccaggtcggatcgcgctcctgagtctgcctgcgtggactgcgaggaccgtaaatagaggcggaagcgtttaaataaaccgtatgttctaaccgtgcttaggtttattttacagaggtgataggacaacactttttgctacttttgctgttgttctgtggccggttattcccaagggaggactcaggcgatgggggaggggcgcggctggtgtaggaggtcggatggagtatggcaagggaagtgacggactttgattacctttgaacaggtggccatggcctcatcgaccactcggggccccagggtttctgacttattttctgggctgccgccggcggtcacaactcccgccaaccagagcgcagaggcctcggcgggcaacgggtcggtggctggcgcggacgctccagccgtcacgcccttccagagcctgcagctggtgcatcagctgaaggggctgatcgtgctgctctacagcgtcgtggtggtcgtggggctggtgggcaactgcctgctggtgctggtgatcgcgcgggtgccgcggctgcacaacgtgacgaacttcctcatcggcaacctggccttgtccgacgtgctcatgtgcaccgcctgcgtgccgctcacgctggcctatgccttcgagccacgcggctgggtgttcggcggcggcctgtgccacctggtcttcttcctgcagccggtcaccgtctatgtgtcggtgttcacgctcaccaccatcgcagtggaccgctacgtcgtgctggtgcacccgctgaggcgcgcatctcgctgcgcctcagcctacgctgtgctggccatctgggcgctgtccgcggtgctggcgctgccgcccgccgtgcacacctatcacgtggagctcaagccgcacgacgtgcgcctctgcgaggagttctggggctcccaggagcgccagcgccagctctacgcctgggggctgctgctggtcacctacctgctccctctgctggtcatcctcctgtcttacgtccgggtgtcagtgaagctccgcaaccgcgtggtgccgggctgcgtgacccagagccaggccgactgggaccgcgctcggcgccggcgcaccttctgcttgctggtggtggtcgtggtggtgttcgccgtctgctggctgccgctgcacgtcttcaacctgctgcgggacctcgacccccacgccatcgacccttacgcctttgggctggtgcagctgctctgccactggctcgccatgagttcggcctgctacaaccccttcatctacgcctggctgcacgacagcttccgcgaggagctgcgcaaactgttggtcgcttggccccgcaagatagccccccatggccagaatatgaccgtcagcgtggtcatctgatgccacttagccaggccttggtcaaggagctccacttcaactggcctcctagggcaccactcgaggtcaatctggtgcttattcttcagcaccagagctagctaagccaacatagggc

SEQ ID NO: 1052 - DNA, 1293 bp; single-stranded, linear
  immediate source library: GENBANK
  immediate source clone: g1002740
ataggaggagctgctcagagtaaatcacagactaaatcagactcaatcacaaaagagttcctgccaggcctttacacagccccttcctccccgttcccgccctcacaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaa

SEQ ID NO: 1053 - DNA, 1659 bp; single-stranded, linear
  immediate source library: GENBANK
  immediate source clone: g1016687
cggccgagccgatcgccgcggggcagttcgggccggctgtcctggcgcgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgccagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggatt

SEQ ID NO: 1054 - DNA, 2320 bp; single-stranded, linear
  immediate source library: GENBANK
  immediate source clone: g1017721
ggggggttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagttatgtgttctcattttgcccgagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaagcttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatctaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaaaaaaaaaaaaaaaaaaaaaaaaa

SEQ ID NO: 1055 - DNA, 3620 bp; single-stranded, linear
  immediate source library: GENBANK
  immediate source clone: g1039418
aattcggcacgaggtgggactttcctctcgctgcctcccggctctgcccgcccttcgaaagtccagggtccctgcccgctaggcaagttgcactcatggcacctccaagtgaagagacgcccctgatccctcagcgttcatgcagcctcttgtccacggaggctggtgccctgcatgtgctgctgcccgctcggggccccgggcccccccagcgcctatctttctcctttggggaccacttggctgaggacctgtgcgtgcaggctgccaaggccagcggcatcctgcctgtgtaccactccctctttgctctggccacggaggacctgtcctgctggttccccccgagccacatcttctccgtggaggatgccagcacccaagtcctgctgtacaggattcgcttttacttccccaattggtttgggctggagaagtgccaccgcttcgggctacgcaaggatttggccagtgctatccttgacctgccagtcctggagcacctctttgcccagcaccgcagtgacctggtgagtgggcgcctccccgtgggcctcagtctcaaggagcagggtgagtgtctcagcctggccgtgttggacctggcccggatggcgcgagagcaggcccagcggccgggagagctgctgaagactgtcagctacaaggcctgcctacccccaagcctgcgcgacctgatccagggcctgagcttcgtgacgcggaggcgtattcggaggacggtgcgcagagccctgcgccgcgtggccgcctgccaggcagaccggcactcgctcatggccaagtacatcatggacctggagcggctggatccagccggggccgccgagaccttccacgtgggcctccctggggcccttggtggccacgacgggctggggctgctccgcgtggctggtgacggcggcatcgcctggacccagggagaacaggaggtcctccagcccttctgcgactttccagaaatcgtagacattagcatcaagcaggccccgcgcgttggcccggccggagagcaccgcctggtcactgttaccaggacagacaaccagattttagaggccgagttcccagggctgcccgaggctctgtcgttcgtggcgctcgtggacggctacttccggctgaccacggactcccagcacttcttctgcaaggaggtggcaccgccgaggctgctggaggaagtggccgagcagtgccacggccccatcactctggactttgccatcaacaagctcaagactgggggctcacgtcctggctcctatgttctccgccgcagcccccaggactttgacagcttcctcctcactgtctgtgtccagaacccccttggtcctgattataagggctgcctcatccggcgcagccccacaggaaccttccttctggttggcctcagccgaccccacagcagtcttcgagagctcctggcaacctgctgggatggggggctgcacgtagatggggtggcagtgaccctcacttcctgctgtatccccagacccaaagaaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatatatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggtgagcgccgcagggctagcctcagtttcccagtctgtagattgggccggggtctcgggcaagccagctggcgcctgagtctctgtactgagaagaaaggctagagtgtgaggccgatgaggatcctggcccccacttggctactctctcactgtggcaagtcagagcactttcagagcctcagtttacccttttccaaaatgagaatagtaatgccttatagggtgagggaagattagactcctgttcacctgtgcctatgagggctcagctcaaagccgagcacacagtcgatgctccataaatggtggtgacgtt

SEQ ID NO: 1056 - DNA, 1990 bp; single-stranded, linear
  immediate source library: GENBANK
  immediate source clone: g1041044
tttacagagttctataaaattcattcaaccaatagagcaataattgagcctacagagacaacttatcagaaaattcattcaatataccttacgagatcatccaatagataagagacaactctagaacagcattcagaacatagtggcactcaataaatttcccctgaatgaatgaattaatgaattagtgcatattttaatcagcctcctttgccctcacccaggaagtcagaggcaccagtgtgagtatccatctgctgtccagtacattcatggattcctcactctcactagacaatgtttgaccaggaagaacagggaatgagaaggagctgctgggtggtgatgagccttggaaagggaggctgggcgagcagagacagaagagaaacacctacctgctgtgacctcacaaacacccaggctgagttttgataagacaggttgaatcacactggggtgacagcctcatccctccaggtacaaacaagaacaggccatggataaccaaagctccacaccgggcttcctccttctgggcttctctgaacacccagggctgggaaggactctcttcgtggatgtcatcacttcctacctcctaaccctagtgggcaacacactcatcatcctgctgtctgcgctggacaccaagctccactctccaatgtactttttcctctccaacctctccttcttggacctctgtttcaccacgagttgtgttccccaaatgctggccaacctctggggcccaaagaagaccatcagcttcctggactgctctgtccagatcttcatcttcctgtccctggggacaactgagtgcatcctcatgaaagtgatggcttttgatcgctacgtggctgtctgccagcccctccactatgccaccatcatccacccccgcctgtgctggcagctggcatctgtggcctgggtcattgggctagtggggtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactccgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacaacctggagccactgtgggggggtcacagggtgggtatgttatctatgagagggagaatgagaaagagagggacagagagataaaagaatttgggtgagaggagataggtagctccataaggcacacaaattcagatattatcattcctatcactgtccatccttaatatttctatcctccattctgtcctatttactgtcatcactcctatagattccctaactccaccatgcctatctctggttatataattgctctccaatggtcatgtcagtgtaggggaactactccatcatagcattctggacacctcgcatgtatctacgtaggtcatgtcagcacaggcttgaaggaacagctactctgagatttaggaagaatgcttctgggatcccccctcggcaatatgagaggatcgggaggccccttcaggaacctgcctcaaatgccaccttctca

SEQ ID NO: 1057 - DNA, 1776 bp; single-stranded, linear
  immediate source library: GENBANK
  immediate source clone: g1041933
atggtgccctccagcccagcggtggagaagcaggtgcccgtggaacctgggcctgaccccgagctccggtcctggcggcgcctcgtgtgctacctttgcttctacggcttcatggcgcagatacggccaggggagagcttcatcaccccctacctcctggggcccgacaagaacttcacgcgggacgaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcgcgactgccagcggggccaccacccgcggcagcccccggcccagggcctgaggagtgccgcggaggagaaggcagcacagcgactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtcgtccgcccaagcctcaggccctgaggctgcagatgagacttgtccccagctggctgtccatcctcctggtgtcagcaagctgggtttgcagtgtcttccaagcgacggtgttcagaatgtgaaccagtga

SEQ ID NO: 1058 - DNA, 2416 bp; single-stranded, linear
  immediate source library: GENBANK
  immediate source clone: g1050529
cctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgcctgggcgccgcacctgccatggtctgggacgtcctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcatgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcaccccaatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgag

SEQ ID NO: 1059 - DNA, 1594 bp; single-stranded, linear
  immediate source library: GENBANK
  immediate source clone: g1053068
gagaggaacatgaactgacgagtaaacatgtatggaaattattctcacttcatgaagtttcccgcaggctatggaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcagctaaatgtggtcaacagtgtcagcagttcagaggacatcaagcccttaccagggcttcccgggattggaaacatgaactacccatccaccagccccggatctctggttaaacacatctgtgctatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagttctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctgagccccaccagccacagcctccccacccaggatgacccctgggcaggtgtgtgtggacccccaccctgcactttcctccacctcccaccctgacccccttcctgtccccaaaatgtgatgcttataataaagaaaacctttctacaaaaaaaaaaaaaaaaaaaaaaccggaattc

SEQ ID NO: 1060 - DNA, 944 bp; single-stranded, linear
  immediate source library: GENBANK
  immediate source clone: g1055280
gttttgaaagttgatggagcgaactgcttttccaaagactcttttgaaaaactttttaagtaggccattctgactttaacatttctctttgtcttaacattagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttgtgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagtgacatagtaggtcaggtgg

SEQ ID NO: 1061 - DNA, 1180 bp; single-stranded, linear
  immediate source library: GENBANK
  immediate source clone: g1063629
gagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcagataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgccgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaaccaggtctaggtcttctccctgcca

SEQ ID NO: 1062 - DNA, 1200 bp; single-stranded, linear
  immediate source library: GENBANK
  immediate source clone: g1063633
caagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatcccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatcatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattc

SEQ ID NO: 1063 - DNA, 2025 bp; single-stranded, linear
  immediate source library: GENBANK
  immediate source clone: g1066050
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggttggggagagacagagaagtgggcaggggcacccaagttgggatttcatttcaggtgcattggagattcttaggagtgtctcttgggggtaatattttattttttaaaaaatgaggat

SEQ ID NO: 1064 - DNA, 993 bp; single-stranded, linear
  immediate source library: GENBANK
  immediate source clone: g1066730
atgatcaccctgaacaatcaagatcaacctgtcacttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgcatggccatttggagagtacttctgccagattattggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcctgcgcagaaaaagtttccgatctggtagtctaaggtcactaagcaatataaacagtgaaatgtta

SEQ ID NO: 1065 - DNA, 1705 bp; single-stranded, linear
  immediate source library: GENBANK
  immediate source clone: g1079575
ncaatcttaacttntngagaanaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggccgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagactcctatgacagttttggggagccttcataccccgaagtctttgagcctcccttgactggctacccaggggaggagctggaggaagaggaggaaagtcaagggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaaaccagttccctacgaggagtgttcccaatgctttgtccatgatgtccttgttattttattgcctttagaaactgagtcctgttcttgttacggcagtcacactgctgggaagtggcttaatactaatatcaataaatagatgagtcctgttagaaaaaaaaaaaaaaaaaaaaa

SEQ ID NO: 1066 - DNA, 4078 bp; single-stranded, linear
  immediate source library: GENBANK
  immediate source clone: g1107686
ctgggcggccgggcgcggggagagggcgcgggagcggctcgtgcggcaggtaccatgcggacgcgcgagcccggcgaggccccggcaggcccgtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatg

SEQ ID NO: 1067 - DNA, 1982 bp; single-stranded, linear
  immediate source library: GENBANK
  immediate source clone: g1122930
ggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgacgtgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtc

SEQ ID NO: 1068 - DNA, 1429 bp; single-stranded, linear
  immediate source library: GENBANK
  immediate source clone: g1124904
aagggagcttgggtaggggccaggctagcctgagtgcacccagatgcgcttctgtcagctctccctagtgcttcaaccactgctctccctgctctactttttttgctccagctcagggatgggggtgggcagggaaatcctgccaccctcacttctccccttcccatctccaggggggccatggccagtacagagtcctccctgttgagatccctaggcctcagcccaggtcctggcagcagtgaggtggagctggactgttggtttgatgaggatttcaagttcatcctgctgcctgtgagctatgcagttgtctttgtgctgggcttgggccttaacgccccaaccctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcgtgcccaacctgttctttgtcacaaccagcaacaaagggaccaccgtcctgtgccatgacaccactcggcctgaagagtttgaccactatgtgcacttcagctcggcggtcatggggctgctctttggcgtgccctgcctggtcactcttgtttgctatggactcatggctcgtcgcctgtatcagcccttgccaggctctgcacagtcgtcttctcgcctccgctctctccgcaccatagctgtggtgctgactgtctttgctgtctgcttcgtgcctttccacatcacccgcaccatttactacctggccaggctgttggaagctgactgccgagtactgaacattgtcaacgtggtctataaagtgactcggcccctggccagtgccaacagctgcctggatcctgtgctctacttgctcactggggacaaatatcgacgtcagctccgtcagctctgtggtggtggcaagccccagccccgcacggctgcctcttccctggcactagtgtccctgcctgaggatagcagctgcaggtgggcggccaccccccaggacagtagctgctctactcctagggcagatagattgtaacacgggaagccgggaagtgagagaaaaggggatgagtgcagggcagaggtgagggaacccaatagtgatacctggtaaggtgcttcttcctcttttccaggctctggagagaagccctcaccctgagggttgccagggaggcagggatatc

SEQ ID NO: 1069 - DNA, 993 bp; single-stranded, linear
  immediate source library: GENBANK
  immediate source clone: g1136797
gaattcggcacgaggcgccttcttgcccggcggctgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctgggtaagttgaccatatatcctcacctcatggatattgaattggttatgatataaattggggatttgaagaagagtttctccttttgaccaaataaagtaccattagttga

SEQ ID NO: 1070 - DNA, 2110 bp; single-stranded, linear
  immediate source library: GENBANK
  immediate source clone: g1144507
atggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccactgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 1071 - DNA, 1786 bp; single-stranded, linear
  immediate source library: GENBANK
  immediate source clone: g1146128
gaattcatctgtcgactgctaccacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcgtaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagcctggggtccatccccttcccccatccctaccactgtgcgcaagaggggcgggctcagagctttgtcacttgccacatggtgtcttccaacatgggagggatcagccccgcctgtcacaataaagtttattatgaaaaaaaaaaaaaaaaaaaaaa

SEQ ID NO: 1072 - DNA, 1769 bp; single-stranded, linear
  immediate source library: GENBANK
  immediate source clone: g1149557
cctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagaaaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttcaaaaaaaaaaaaaaaaaaaaacttcagtaagtacgtgttatttttttcaataaaattctattacagtatgtcaaaaaaaaaaaaaaaaaa

SEQ ID NO: 1073 - DNA, 773 bp; single-stranded, linear
  immediate source library: GENBANK
  immediate source clone: g1154851
atgtcggattcggaggaggagagccaggaccggcaactgaaaatcgtcgtgctgggggacggcacctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagcgtattgtcagggcagaaatagtgaagtacccggaagaagaaaatcaacataccacctctactcagagtagaatctgttcagtacagtagtgcagagggtggtgaaggcagatattgtaaactacaaccaggaacctatgtcaaggactgttaaccctcctagaagctctatgtgtgcagttcagtgagcgcatttttcc

SEQ ID NO: 1074 - DNA, 3884 bp; single-stranded, linear
  immediate source library: GENBANK
  immediate source clone: g1160182
ccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcaaaaaa

SEQ ID NO: 1075 - DNA, 1385 bp; single-stranded, linear
  immediate source library: GENBANK
  immediate source clone: g1160928
cgcagcagcagggccgggtcctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattc

SEQ ID NO: 1076 - DNA, 2563 bp; single-stranded, linear
  immediate source library: GENBANK
  immediate source clone: g1160974
gggcagcaggtttacaaaggaggaaaacgacttcttctagatttttttttcagtttcttctataaatcaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggtccctgtctcagaaaggagtcttgctcgcgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcatctaaactttagaattaatttattaaatgtattataactttaactttcatcctaatttggtttccttaaaatttttatttatttacaactcaacaaacattgttttgtgtaacatatttaatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaaaccccccaaatt

SEQ ID NO: 1077 - DNA, 1984 bp; single-stranded, linear
  immediate source library: GENBANK
  immediate source clone: g1162923
cccgagagcgcccattcacccccctcacccacctccccgcgttcccacttccccgcactctgacccggccggacgcccctcccctatcttgccgcccgccccctccagggggctctgctcccaccccagggagcccatccgacctctgcttgacttcccgccgcttccttcaggggcctcggctcatcgggtgcccctccccaaacttccaacccgtttgctccaggagttcctgccccatccccgagggcgcccaaatagccacactgtgtcctcctgtagtcgccgccccctgacctagcgcgacccagcgcccccgcccatgtccccccactcacctcccccggggggcgtggtgagtcgcggtctgttctcacggacggtccccgtccagcctgcgcttcgccggggccctcatctgctttcccgccaccctatcactcccttgccgtccaccctcggtcctcatggtcccagagccgggcccaaccgccaatagcaccccggcctggggggcagggccgccgtcggccccggggggcagcggctgggtggcggccgcgctgtgcgtggtcatcgcgctgacggcggcggccaactcgctgctgatcgcgctcatctgcactcagcccgcgctgcgcaacacgtccaacttcttcctggtgtcgctcttcacgtctgacctgatggtggggctggtggtgatgccgccggccatgctgaacgcgctgtacgggcgctgggtgctggcgcgcggcctctgcctgctctggaccgccttcgacgtgatgtgctgcagcgcctccatcctcaacctctgcctcatcagcctggaccgctacctgctcatcctctcgccgctgcgctacaagctgcgcatgacgcccctgcgtgccctggccctagtcctgggcgcctggagcctcgccgctctcgcctccttcctgcccctgctgctgggctggcacgagctgggccacgcacggccacccgtccctggccagtgccgcctgctggccagcctgccttttgtccttgtggcgtcgggcctcaccttcttcctgccctcgggtgccatatgcttcacctactgcaggatcctgctagctgcccgcaagcaggccgtgcaggtggcctccctcaccaccggcatggccagtcaggcctcggagacgctgcaggtgcccaggaccccacgcccaggggtggagtctgctgacagcaggcgtctagccacgaagcacagcaggaaggccctgaaggccagcctgacgctgggcatcctgctgggcatgttctttgtgacctggttgcccttctttgtggccaacatagtccaggccgtgtgcgactgcatctccccaggcctcttcgatgtcctcacatggctgggttactgtaacagcaccatgaaccccatcatctacccactcttcatgcgggacttcaagcgggcgctgggcaggttcctgccatgtccacgctgtccccgggagcgccaggccagcctggcctcgccatcactgcgcacctctcacagcggcccccggcccggccttagcctacagcaggtgctgccgctgcccctgccgccggactcagattcggactcagacgcaggctcaggcggctcctcgggcctgcggctcacggcccagctgctgcttcctggcgaggccacccaggaccccccgctgcccaccagggccgctgccgccgtcaatttcttcaacatcgaccccgcggagcccgagctgcggccgcatccacttggcatccccacgaactgacccgggcttggggctggccaatggggagctggattgagcagaacccagaccctgagtccttgggccagctcttggctaagaccaggaggctgcaagtctcctagaagccctctgagctccagaggggtgcgcagagctgaccccctgctgccatctccaggccccttacctgcagggatcatagctgactcaga

SEQ ID NO: 1078 - DNA, 1913 bp; single-stranded, linear
  immediate source library: GENBANK
  immediate source clone: g1166511
tctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattgaaagatgcagaatctcc

SEQ ID NO: 1079 - DNA, 1232 bp; single-stranded, linear
  immediate source library: GENBANK
  immediate source clone: g1171145
aagcttccttgaggtttctaaaatttatacaaaaacatcatatgtaagtaaactcaccagatttggcatctgctctttggtgatggacccagaagaaacttcagtttatttggattattactatgctacgagcccaaactctgacatcagggagacccactcccatgttccttacacctctgtcttccttccagtcttttacacagctgtgttcctgactggagtgctggggaaccttgttctcatgggagcgttgcatttcaaacccggcagccgaagactgatcgacatctttatcatcaatctggctgcctctgacttcatttttcttgtcacattgcctctctgggtggataaagaagcatctctaggactgtggaggacgggctccttcctgtgcaaagggagctcctacatgatctccgtcaatatgcactgcagtgtcctcctgctcacttgcatgagtgttgaccgctacctggccattgtgtggccagtcgtatccaggaaattcagaaggacagactgtgcatatgtagtctgtgccagcatctggtttatctcctgcctgctggggttgcctactcttctgtccagggagctcacgctgattgatgataagccatactgtgcagagaaaaaggcaactccaattaaactcatatggtccctggtggccttaattttcaccttttttgtccctttgttgagcattgtgacctgctactgttgcattgcaaggaagctgtgtgcccattaccagcaatcaggaaagcacaacaaaaagctgaagaaatctataaagatcatctttattgtcgtggcagcctttcttgtctcctggctgcccttcaatactttcaagttcctggccattgtctctgggttgcggcaagaacactatttaccctcagctattcttcagcttggtatggaggtgagtggacccttggcatttgccaacagctgtgtcaaccctttcatttactatatcttcgacagctacatccgccgggccattgtccactgcttgtgcccttgcctgaaaaactatgactttgggagtagcactgagacatcagatagtcacctcactaaggctctctccaccttcattcatgcagaagattttgccaggaggaggaagaggtctgtgtcactctaaagggaactgtgacatttcaagctctgttggtgggtttaggagttaatttttgtcagcaacaaagaaa

SEQ ID NO: 1080 - DNA, 3410 bp; single-stranded, linear
  immediate source library: GENBANK
  immediate source clone: g1171563
cttttgtgtcggatgaggaggaccaaccatgagccagagcccgggtgcaggctcaccgccgccgctgccaccgcggtcagctccagttcctgccaggagttgtcggtgcgaggaattttgtgacaggctctgttagtctgttcctcccttatttgaaggacaggccaaagatccagtttggaaatgagagaggactagcatgacacattggctccaccattgatatctcccagaggtacagaaacaggattcatgaagatgttgacaagactgcaagttcttaccttagctttgttttcaaagggatttttactctctttaggggaccataactttctaaggagagagattaaaatagaaggtgaccttgttttagggggcctgtttcctattaacgaaaaaggcactggaactgaagaatgtgggcgaatcaatgaagaccgagggattcaacgcctggaagccatgttgtttgctattgatgaaatcaacaaagatgattacttgctaccaggagtgaagttgggtgttcacattttggatacatgttcaagggatacctatgcattggagcaatcactggagtttgtcagggcatctttgacaaaagtggatgaagctgagtatatgtgtcctgatggatcctatgccattcaagaaaacatcccacttctcattgcaggggtcattggtggctcttatagcagtgtttccatacaggtggcaaacctgctgcggctcttccagatccctcagatcagctacgcatccaccagcgccaaactcagtgataagtcgcgctatgattactttgccaggaccgtgccccccgacttctaccaggccaaagccatggctgagatcttgcgcttcttcaactggacctacgtgtccacagtagcctccgagggtgattacggggagacagggatcgaggccttcgagcaggaagcccgcctgcgcaacatctgcatcgctacggcggagaaggtgggccgctccaacatccgcaagtcctacgacagcgtgatccgagaactgttgcagaagcccaacgcgcgcgtcgtggtcctcttcatgcgcagcgacgactcgcgggagctcattgcagccgccagccgcgccaatgcctccttcacctgggtggccagcgacggctggggcgcgcaggagagcatcatcaagggcagcgagcatgtggcctacggcgccatcaccctggagctggcctcccagcctgtccgccagttcgaccgctacttccagagcctcaacccctacaacaaccaccgcaacccctggttccgggacttctgggagcaaaagtttcagtgcagcctccagaacaaacgcaaccacaggcgcgtctgcgacaagcacctggccatcgacagcagcaactacgagcaagagtccaagatcatgtttgtggtgaacgcggtgtatgccatggcccacgctttgcacaaaatgcagcgcaccctctgtcccaacactaccaagctttgtgatgctatgaagatcctggatgggaagaagttgtacaaggattacttgctgaaaatcaacttcacggctccattcaacccaaataaagatgcagatagcatagtcaagtttgacacttttggagatggaatggggcgatacaacgtgttcaatttccaaaatgtaggtggaaagtattcctacttgaaagttggtcactgggcagaaaccttatcgctagatgtcaactctatccactggtcccggaactcagtccccacttcccagtgcagcgacccctgtgcccccaatgaaatgaagaatatgcaaccaggggatgtctgctgctggatttgcatcccctgtgaaccctacgaatacctggctgatgagtttacctgtatggattgtgggtctggacagtggcccactgcagacctaactggatgctatgaccttcctgaggactacatcaggtgggaagacgcctgggccattggcccagtcaccattgcctgtctgggttttatgtgtacatgcatggttgtaactgtttttatcaagcacaacaacacacccttggtcaaagcatcgggccgagaactctgctacatcttattgtttggggttggcctgtcatactgcatgacattcttcttcattgccaagccatcaccagtcatctgtgcattgcgccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatattttatgtgacatcaagtgactacagagtgcagacgacaaccatgtgcatctctgtcagcctgagtggctttgtggtcttgggctgtttgtttgcacccaaggttcacatcatcctgtttcaaccccagaagaatgttgtcacacacagactgcacctcaacaggttcagtgtcagtggaactgggaccacatactctcagtcctctgcaagcacgtatgtgccaacggtgtgcaatgggcgggaagtcctcgactccaccacctcatctctgtgattgtgaattgcagttcagttcttgtgtttttagactgttagacaaaagtgctcacgtgcagctccagaatatggaaacagagcaaaagaacaaccctagtacctttttttagaaacagtacgataaattatttttgaggactgtatatagtgatgtgctagaactttctaggctgagtctagtgcccctattattaacaattcccccagaacatggaaataaccattgtttacagagctgagcattggtgacagggtctgacatggtcagtctactaaaaaacaaaaaaaaaaaacaaaaaaaaaaaaacaaaagaaaaaaataaaaatacggtggcaatattatgtaaccttttttcctatgaagttttttgtaggtccttgttgtaactaatttaggatgagtttctatgttgtatattaaagttacattatgtgtaacagattgattttctcagcacaaaataaaaagcatctgtattaatgtaaagatactgagaataaaaccttcaaggtttt

SEQ ID NO: 1081 - DNA, 1700 bp; single-stranded, linear
  immediate source library: GENBANK
  immediate source clone: g1174071
cggcggcccagactatccgctcccaccgcgcccccggcccacctggtggccccggcctggccgccgcccccgcgctgtgcccgggagctcgtcccggacgcgcgaccgggcggcgggggctcggcggccaccgctgcctcaagggagcgaggcgggagggtgtgtgtgcgcggctgtgagcaggggtgccggcgggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctggtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattaactactcccacttcacgtgcgccacagacaccgagaatatccgctttgtctttgctgccgtcaaggacaccatcctccagttgaacctgaaggagtacaatctggtctaattgtgcctgctagacacccgccctgcccttccctggtgggctattgaagatacacaagagggactgtatttctgtggaaaacaatttgcataatactaatttattgccgtcctggactctgtgtgagcgtgtccacagagtttgagtaaatattatgattttatttaaactattccagaggaaaaacagaggatgctgaagtacagtcccagcacatttcctctctatctttttttaggcaaaccttgtgactcagtgtattttaaattctcagtcatgcactcacaaagataagacttgtttctttctgtctctctctctttttcttttctatggagcaaaacaaagctgatttccctttttttcttcccccgctaattcatacctccctcctgatgtt

SEQ ID NO: 1082 - DNA, 606 bp; single-stranded, linear
  immediate source library: GENBANK
  immediate source clone: g1174146
atggcaggaaaatcttcactttttaaagtaattctccttggagatggtggagttgggaagagttcacttatgaacagatatgtaactaataagtttgatacccagctcttccatacaataggtgtggaatttttaaataaagatttggaagtggatggacattttgttaccatgcagatttgggacacggcaggtcaggagcgattccgaagcctgaggacaccattttacagaggttctgactgctgcctgcttacttttagtgtcgatgattcacaaagcttccagaacttaagtaactggaagaaagaattcatatattatgcagatgtgaaagagcctgagagctttccttttgtgattctgggtaacaagattgacataagcgaacggcaggtgtctacagaagaagcccaagcttggtgcagggacaacggcgactatccttattttgaaacaagtgcaaaagatgccacaaatgtggcagcagcctttgaggaagcggttcgaagagttcttgctaccgaggataggtcagatcatttgattcagacagacacagtcaatcttcaccgaaagcccaagcctagctcatcttgctgttga

SEQ ID NO: 1083 - DNA, 624 bp; single-stranded, linear
  immediate source library: GENBANK
  immediate source clone: g1174148
atgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctggtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcgtccaggccagtccccgagatcctgaaaacttcccatttgttgtgttgggaaacaaggttgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctga

SEQ ID NO: 1084 - DNA, 2177 bp; single-stranded, linear
  immediate source library: GENBANK
  immediate source clone: g1184861
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggttgagggtgctcactcggatgcggggtcccagggcacggacagccacacagacctgcccccgcctcttgagcggacaggcggcatcggggactcccggtccccctccttccaacccgatgtggccagtagccgtgacgggatggacaacgagacaggcacggagtccatggtcagtcaccggcgggaccgtgcccgacgccggaaccgcgaggaggccgcccggaccaatgggcaccctaggggagaccgacggcgggatgtgggcctccctccagacagcgcgtccaccgccctcagcagcgagcttgagtccagcagctttgtggactcggacgaggatgacagcacgagcaggctcagcagctccacggagcagagcacctcatccagactcatccggaagcacaaacgccggcggaggaagcagcgccttcggcaggcggaccgggcctcctccttcagcagcatgaccgactccaccatgtcactcaacatcatcacggtcactctcaacatggaaagacatcactttctgggcatctgcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagtctcactgtggccaagtgctgggacccaacgccccgaagctacttcaccgtcccacggcctgacccggtgcggcccatcgaccccgccgcctggctgtcccacacggcggcactgacaggagccctgccccgcccccagctggaagaggcgccgctgacggtggagagtgacatgaataccgtcgtccgggtcatgcagctgccagactcgggactggagatccgcgaccgcatgtggcttaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagtggcagcaccgggagtcagcagagtgaagggagcaaaagcagtgggtccacccggaacaccctccggcccccggcctgtgagaaggagcgtcgggcggcgggatctggggacagtgacagtgaatcggatcacacggcaccgagtggggtgggaagcagctggcgagagcgtccggccgaccagctcagccgtggcagcagcccacgcagtcaggcttcctcgtacgccccagggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgcccagcc

SEQ ID NO: 1085 - DNA, 1201 bp; single-stranded, linear
  immediate source library: GENBANK
  immediate source clone: g1199579
tttttcttcttctatcacagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagt

SEQ ID NO: 1086 - DNA, 1805 bp; single-stranded, linear
  immediate source library: GENBANK
  immediate source clone: g1199603
gaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagcta

SEQ ID NO: 1087 - DNA, 2924 bp; single-stranded, linear
  immediate source library: GENBANK
  immediate source clone: g1203817
ggcttctggttcggcccacctctgaaggttccagaatcgatagtgaattcgtggttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctagagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttggaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaagaacagagggttttgattttaaaaagaagaaaaaaaaaccttattttttctttcttggcctcaagttcaatatggagaggattgcttccctgaatcctctcttccttccccttttagag

SEQ ID NO: 1088 - DNA, 2481 bp; single-stranded, linear
  immediate source library: GENBANK
  immediate source clone: g1209017
gcccctcgccggtacctcagcaaggtgcgttgccgccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaagtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 1089 - DNA, 1572 bp; single-stranded, linear
  immediate source library: GENBANK
  immediate source clone: g1209672
ttggcacgaggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatatgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgaaaaaaaaaaaaaaaaaa

SEQ ID NO: 1090 - DNA, 2638 bp; single-stranded, linear
  immediate source library: GENBANK
  immediate source clone: g1216368
gaggaaaggggaaatgcggcccgctccccactcagtgccactctgtgccactccgtgccaggccctgagggcacccggttgctgcttccttccgtctttccccaaggactatcagagatgccagcgtgacccctgacacgtgtgtgcagcagcctgcagctgccccaagccatggctgaacactgactcccagctgtgggcttcaccattacagactccccagggcttcaaagacttctcagcttcgagcatggcttttggctgtcagggcagctgtacaatagtggatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaaaaaaa

SEQ ID NO: 1091 - DNA, 800 bp; single-stranded, linear
  immediate source library: GENBANK
  immediate source clone: g1216372
gcaacatagcacgttcgcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaagggagagggatgaaaagccgaatctgagatatccatcacactggggggcgtcgagcatgatctagagggccta

SEQ ID NO: 1092 - DNA, 1076 bp; single-stranded, linear
  immediate source library: GENBANK
  immediate source clone: g1217590
gtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttc

SEQ ID NO: 1093 - DNA, 3590 bp; single-stranded, linear
  immediate source library: GENBANK
  immediate source clone: g1220312
cgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttccctaaaaaaaaaaaaaggaattc

SEQ ID NO: 1094 - DNA, 2655 bp; single-stranded, linear
  immediate source library: GENBANK
  immediate source clone: g1245045
cggcgtgcgcggacgggcagccagcagcggaggcgcggcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgtttggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatcgctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaagccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcgcccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcaaaaaaaaaaaaaaaaaaaaaaaaaaaaaaaaa

SEQ ID NO: 1095 - DNA, 2577 bp; single-stranded, linear
  immediate source library: GENBANK
  immediate source clone: g1245054
aatattttccttgacctaatgccatcttgtgtccccttgcagagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacatgaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacattaagagtgtgaaggctggtctgaaggtagtgagctatctcaatcggattgttcacactcagttacagattgaactccttgttctacttccctgcttctctctactgcaattgactagtctttaaaaaaaagtgtgaagagtaagcaatagggataaggaaataagatct

SEQ ID NO: 1096 - DNA, 1953 bp; single-stranded, linear
  immediate source library: GENBANK
  immediate source clone: g1245056
gaattcatgcctcccaaagtgctaggattacaggcatgagccacagctcccggtctatcatttaaccttaattacatctttaaaggcccaaatagtctcacccactccaaatagtcacacccacaccggaggttgagcacttcaacacatgaatttggggaggacacagttcagtccataacatccccctaatttttaaaaaataaaaatgtttttaaggagtgaatgtcttttatgtgtctctgtgaccaggtcccgctgccttgatggattatacacttgacctcagtgtgacaacagtgaccgactactactaccctgatatcttctcaagcccctgtgatgcggaacttattcagacaaatggcaagttgctccttgctgtcttttattgcctcctgtttgtattcagtcttctgggaaacagcctggtcatcctggtccttgtggtctgcaagaagctgaggagcatcacagatgtatacctcttgaacctggccctgtctgacctgctttttgtcttctccttcccctttcagacctactatctgctggaccagtgggtgtttgggactgtaatgtgcaaagtggtgtctggcttttattacattggcttctacagcagcatgtttttcatcaccctcatgagtgtggacaggtacctggctgttgtccatgccgtgtatgccctaaaggtgaggacgatcaggatgggcacaacgctgtgcctggcagtatggctaaccgccattatggctaccatcccattgctagtgttttaccaagtggcctctgaagatggtgttctacagtgttattcattttacaatcaacagactttgaagtggaagatcttcaccaacttcaaaatgaacattttaggcttgttgatcccattcaccatctttatgttctgctacattaaaatcctgcaccagctgaagaggtgtcaaaaccacaacaagaccaaggccatcaggttggtgctcattgtggtcattgcatctttacttttctgggtcccattcaacgtggttcttttcctcacttccttgcacagtatgcacatcttggatggatgtagcataagccaacagctgacttatgccacccatgtcacagaaatcatttcctttactcactgctgtgtgaaccctgttatctatgcttttgttggggagaagttcaagaaacacctctcagaaatatttcagaaaagttgcagccaaatcttcaactacctaggaagacaaatgcctagggagagctgtgaaaagtcatcatcctgccagcagcactcctcccgttcctccagcgtagactacattttgtgaggatcaatgaagactaaatataaaaaacattttcttgaatggcatgctagtagcagtgagcaaaggtgtgggtgtgaaaggtttccaaaaaaagttcagcatgaaggatgccatatatgttgttgccaacacttggaacacaatgactaaagacatagttgtgcatgcctggcacaacatcaagcctgtgattgtgtttattgatgatgttgaacaagtggtaactttaaaggattctgtatgccaagtgaaaaaaaaagatgtctgacctccttacatatgcaaaaatataccttcagagactgtcagtaggctggaagaagtggatattgaagttttgacatcaatgatgaggctccagttgtctattcattgactgatggtgaaatggctggagtgattctgaatcaaggtgattgtgattatagtgacaatgaagatgatgctattaatactgcataaaaagtgcctgtagatgacatggtgaaaatatttgacaggcttatggaaggactacagcagcacgcattcataacagaacaagaaattatgtcagcttataaaatcaaacagagacttctagacaaaaaccattgttgatgaggcagatgcctctaga

SEQ ID NO: 1097 - DNA, 1679 bp; single-stranded, linear
  immediate source library: GENBANK
  immediate source clone: g1245058
aactgtagtgcattttgccttctttccttcttagagtcacctctactttcctgctaccgctgcctgtgagctgaaggggctgaaccatacactcctttttctacaaccagcttgcattttttctgcccacaatgagcggggtaagatttttatttttggcaaggggtataatttgggttcactgtggctacttgaacactacactgcagctaactctatctttgtttcctttccaggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccactggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaccatttccagaatattccatga

SEQ ID NO: 1098 - DNA, 423 bp; single-stranded, linear
  immediate source library: GENBANK
  immediate source clone: g1245391
ggagccatcctcaccaccatgctggccacacggaatttctcagcagccaagagtttactcaacaagaaagcagatggagtcaagccccagacgaatagcaccaaaaacagtgcagccgccaccagccccaaagggacgcttcctcctgccgccctggagtcttctgacagtgccaataccaccatagaggatgaagacgctaaagcccggaatcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacactactatcctgaacccg

SEQ ID NO: 1099 - DNA, 3339 bp; single-stranded, linear
  immediate source library: GENBANK
  immediate source clone: g1246754
atgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgtctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaaggcctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacgcggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatag

SEQ ID NO: 1100 - DNA, 2240 bp; single-stranded, linear
  immediate source library: GENBANK
  immediate source clone: g1255784
ctttgcggccacttctgcaggcgtcccttcttagctctcgcccgcccctttctgcagcctaggcggcccgggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagggcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatgggacagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgtcgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatcggtgtcttgtagatatgtgcaaggtagcatgatgagcaacttgagtttgttgccactgagaagcaggcgggttgggtgggaggaggaagaaaggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaag

SEQ ID NO: 1101 - DNA, 2771 bp; single-stranded, linear
  immediate source library: GENBANK
  immediate source clone: g1256002
gagtcgccgcttccgccttgaccaggtggagctggagacctggtctctctagggcctgccctgagctcaccatctgaaggagagtgccatcatccttaggaactccttctccagacatgcttcccgaggctggctccctgtggctactgaagctgctccgggacatccagttggcccagttttactggcccatcctagaggagcttaatgtcacccggccagggcacttcgactttgtaaagcctgaggacctggacggcattggcatgggccggcctgcccaacgcagactgtccgaagctctgaaaagcctacgttctgggcctaagtctaagaactgggtctacaagatccttggaggttttgcccctgagcacaaggagcccaccctgcccacggacagcccacggcacctccctgagccagaggggggcctcaagtgtctgatcccagagggtgctgtttgcagaggggagctgctgggttcaggctgcttcggtgtggtgcaccgagggctgtggacgctgcccagtggcaagagtgtcccagtggctgtcaagtccctccgggtaggtcccgaaggcccgatgggcacagaactgggggacttcctgcgagaggtatcggtcatgatgaacttggagcacccacacgtgctgcgtctgcacggccttgtactgggccagcctctgcagatggtgatggagctggcgccactgggctccctgcacgcgcgcttaacggccccggccccgacacccccgctgctcgtggccctgctctgcctcttcctgcggcagctggcgggagccatggcgtacctgggggcccgcgggctggtgcaccgagacctcgctacgcgcaacctacagctggcgtcgccgcgcaccatcaaggtggctgacttcgggctggtgcggcctctgggcggtgcccggggccgctacgtcatgggcgggccccgccctatcccctacacctggtgtgccccagagagcctgcgccacggagccttctcgtctgcctcggacgtgtggatgtttggggtgacgctgtgggagatgttctccgggggcgaggaaccctggcccggggtcccaccgtacctcatcctgcagcggctggaggacagagcccggctgcctaggcctcccccctcctccagggccctctactccctcgccttgcgctgctgggccccccaccctgccgaccggcctagcttttcccacctggaggggctgctgcaagaggccgggccttcggaagcatgttgtgtgagggatgccacagaaccaggcgccctgaggatggagactggtgaccccatcacagtcatcgagggcagctcctctttccacagccccgactccacaatctggaaggaccagaatggtcgcaccttcaaagtgggcagcttcccagcctcggcagtgacgctgacagatgcggggggcttgccagccacccgtccagtccacagaggcacccctgcccggggagatcaacacccaggaagcatagatggagacagaaagaaggcaaatctttgggatgcgcccccagcacggggccagaggaggaacatgcccctggagaggatgaaaggcatttccaggagtctggagtcagttctgtccctcggtcctcgtcccacagggggtggttcaagcccccctgaaattcgacaagccagagctgtgccccagggacctccaggcctgcctccacgcccacctttatcctctagctctcctcagcccagccagccctctagggagaggcttccctggcccgaaagaaaacccccacacaatcaccccatgggaatgcctggagcccgtaaagccgctgccctctctggaggcctcttgtccgatcctgagttgcagaggaagattatggaaatggagctgagtgtgcattgggtcacccaccaggagtgccagacagcactaggagccactgggggagatgtggcttctgccatccggaacctcaaggtagatcagctcttcctcctgagtagccggtccagagctgactgctggcgcatcctggagcattaccagtgggacctctcagctgccagccgttatgtcctggccaggccctgagcccagcttctgcgggcacagacaccagcatgaaaagcctaggtccctgagggcctggccacatgggaccaagtggaaccagaacaaggccccgacaggggtagacgttccacttgtggagatcccacctgccgctaggcacgtggaggaggagcccagagttgggcactggcaaatgtctcctccctcccatgctccttggcttctgaaggctgaagcccctttggctgggccaagaaggatctagtctgcccactacattctcaaacaagaggacttggaggaaaagagctactatacatcatatgcagaggaagcttctacgcgctagagaggatcaaggggccacactggaccatgtgaacagccatccggaactgccatcagctaccacactggactctgcagggcagccatcctggatgatggaagccaccatattgacctggggtataggcccaaactgccttcgtttggtccagggccatcgtgggtgatgacgattgctctcttgcactcatggacatttgatgctggtagtatggattatgagatggactagcccctgctccagcccagttctcacattcccctttgttttttcccataccaactgcttctaccctcccctattacatacatctttcaatgtcc

SEQ ID NO: 1102 - DNA, 1539 bp; single-stranded, linear
  immediate source library: GENBANK
  immediate source clone: g1256016
atggacctcaaggaaagccccagtgagggcagcctgcaaccttctagcatccagatctttgccaacacctccaccctccatggcatccgccacatcttcgtgtatgggccgctgaccatccggcgtgtgctgtgggcagtggccttcgtgggctctctgggcctgctgctggtggagagctctgagagggtgtcctactacttctcctaccagcatgtcactaaggtggacgaagtggtggctcaaagcctggtcttcccagctgtgaccctctgtaacctcaatggcttccggttctccaggctcaccaccaacgacctgtaccatgctggggagctgctggccctgctggatgtcaacctgcagatcccggacccccatctggctgacccctccgtgctggaggccctgcggcagaaggccaacttcaagcactacaaacccaagcagttcagcatgctggagttcctgcaccgtgtgggccatgacctgaaggatatgatgctctactgcaagttcaaagggcaggagtgcggccaccaagacttcaccacagtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggacgaagggagccacgatgagaatgtgagtacttgtgacacaatgccaaaccactctgaaaccatcagtcacgctgtgaacgtgcccctgcagacgaccctggggaccttggaggagattgcctgctga

SEQ ID NO: 1103 - DNA, 2861 bp; single-stranded, linear
  immediate source library: GENBANK
  immediate source clone: g1256386
ctccgtcccaggggagaaggagaggcgtctgcagggggcagagaccgcagctacctgccgggtgcgccccccacccaggagcgctcgcttcgccccctttcctccccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaatctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccacgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacagcatatttcgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaataaaaaaaaaaaaa

SEQ ID NO: 1104 - DNA, 1376 bp; single-stranded, linear
  immediate source library: GENBANK
  immediate source clone: g1262810
gaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggt

SEQ ID NO: 1105 - DNA, 4065 bp; single-stranded, linear
  immediate source library: GENBANK
  immediate source clone: g1276900
atgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaa

SEQ ID NO: 1106 - DNA, 2457 bp; single-stranded, linear
  immediate source library: GENBANK
  immediate source clone: g1293897
ggccggcgctggtggcggggccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttgggcctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataacgaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggattgggtttgatttgttttgttttttttaattccattttgataatttttttcctgctctgggtggtggtggcacatggatgaatgagtatttaataaaagttccaaatttcaaaaaaaaaaa

SEQ ID NO: 1107 - DNA, 925 bp; single-stranded, linear
  immediate source library: GENBANK
  immediate source clone: g1296608
ccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 1108 - DNA, 1571 bp; single-stranded, linear
  immediate source library: GENBANK
  immediate source clone: g1296659
ctcagtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcaaaaaaaaa

SEQ ID NO: 1109 - DNA, 4078 bp; single-stranded, linear
  immediate source library: GENBANK
  immediate source clone: g1310668
gatcttcctggcttctgtcttttttctaacttgaaatctcaaagggctctttggttttaagttacatcatcagtgtttctcggcctttttctttatcattactctctccctgccaaaaggagacaaattaaatttctcctgtagaaaaattaagtatgaaggaataaggttttgtcaggtaggattgtttttatgagtcccaaaccagcataatatgtaagatttgtttggccaggtgtggtggctcacacctataatcccagcactttgggaggccgaggtgggcggatcacctgaggtcaggagttcgagaccagcctggccaacatggcaaaatcctgtctctactaaaaatacaaaaattagctgggcgtggtggcgggtgctttaatccagctgctcaggaggctgaggcaggagaattgcttaaacccggaagtggaggttgcagtgagccgagatcgtgccactgacctccagcctggttgacagagtgagactctgtcccaaaaaataaaataaaaagatttgttgtgtcccctatgaaccaattctcaccccttggacattattgcccctgagaatgcatggtatgtccacttataggaggagctgttacacatttaatggtgttcaactctcctttctattttgataagcctaaaattattttcctttttaagttcccttcttatagtcccacttttgtcagtattaaagttgttccagtctcctagtttagaaataggccatgactatattcggtttctcttgggccaggcgtggtggctcatgcctgtaatcccagcactttgggaggcagaagcaggaggatcacttgagcccaggagttggagaccagcctgggcaacatggcaaaaccccttctacaaaaaatataaaaaattagccgggcctggtggcatacacctgtagtcccagctacttgggaggctgaggtgggaggatcacctaagccagagaggttgaggcttcagagagcaaaattctccagcctgggcaacagagtgagaccctgttcaacaataaaaaaatttttttaaaaaaatttctctcttctcgtcctcagtatctaaaatctcccaccaattcttttttaactttaacttcttttaagtttattaacactcctagatcccacagatgttgccctaaagtcattctgtttaacgcttaaaatagggtaaaaattagtcagattgttgccatcgtttttcaagctcaagttagatgttgcaggtacacttgtctcctttaaacatcatttatgatgtcattctttggagtgttactatacggtcagtaagtcctgtgaagaatggaacaccgctctgagagaacaaagacgtgatggaatgcgggttgtgtatgtgtcttacggagagcctctgaagtgacattaaactgggagctaagggatcaatagtttaaacaggtggctagggaggggaagaacattccaggcaaagagaaccatgcaagagacccaaagaccctggannacctggaagaggagtgtggtagaccacagggtgcatctaagaaggactgagaagaggtggtgaacattggcctggctcagttatggcgttgaaggccctggtaaaaagtagatttatgacaaaaaattagcccaggcatggtggtacatgcctgtaatcccagcttcttgggaggctgaggtgggagaatcgcttgagcccaggaggtggaggttgcagtgagctgagatagtgccagtgcactccagcctgggagacactgtgtgaccccatctcaaaaaaaaaagtagatttatcttcagtgggcagccattgtatcaaggaatggtgtgctctgattgacccagtatcactgtgactgctctgtagagagtgatttacaagtagacaaaaatgaaataggagatgggcttccaatttcaagctctgctctaggttttattgttattaacataacatggacatacttgttcaacatttttcttttatgcaagtaagacataaagtctcaaaaactcaaacaacacagtataatatgaatcaatcacttctatgactctgtacttatgtatgtacattacaagtatatgtattaaaattttatgagattacactgtgtatttttaatgtgctgttttatgcagtatgtgttagagcttttttctgccatgttaaatccctataaaaggaccccttttctcatgtcagtattttctcctaatgttatacactcattcttcatatttttttttcttcttcttcttttagacgaaggctcactctgtcgcccaggctggagtgcagtggccaaatctcggctcactgtaagctccacctcccgggttcaagtgatttctcctgactcagcctcctgagtagctgggactacaggtgcccactaccacaccctgctattttttgtatattcagaggagactgggtttcaccgtgttggtcaggctgatctcgaactcctgacctcaagtaatccacccacctcggcctcccaaagtgctgggattacaggcatgagcaccgtgncccggcctcattcttcatattattttaaacatttttttaaaagctaacatcacactttcattaaaatgcacctttcataaaattcctcncccatncattttcatatacctataanttctataaccactcgccatttcaagtattgtacgatatggctgttgaagcaatatcctttaaaatccatttaatcatttcacgcccatttcatgatttaacgctacaactggccctgtttttcttttgttcatttttctttttcatttttgccattacttttgaaatttataaacaaagtgatacactcacctgggtaaaacaagttgtgtggacagctcatagtaaaaacattcctgtttcctgactctgctgctccatcagccacagtgtctgtccaaaggcactcagttttcacctttctagctgttccatattgggtttgtcttcctactccagacaatatgtttacatattgttatttttctctctcatgtaaacaataaatgcattcacatggttaaaaaataaatataaaacgtgcacagtgaaaagtttctttcatgtctgtagctcttgtctatccaggttctggtcattggcctctaaaaagtgagctgtctcatgtaaatgtcatttcacaaattatgcctgaaaatctgaagagtaaaactctaagttggaatgctgagtgcatatatttatgacattgattgataattgtcaaaatgtctgtccttcgtatcagtttacattcacaagtaatgtgtgtcttcagacttcgggtttgtgctagtgtaacaggtggaaaatggtacctcagtatcctttaaatttagtgtattgtgatatactgttatttctcagtttatcaatattttgtaatttctattgactttccctatattatagatgaggatgtagcttttttatattacctccccaaatgcctagcttcccaagaatttatgttagagtcatgtcagtgatgaatgcttacattgctttgactttgtaattagttgttcactgtagagtcaagtagtacagtatgattatagttctttttaatttttttatttttcctctgaagctaatacttctttttaaaaatatattttatttggggggttttgactccgtgctgttattgtagagttttgtttatttttttcttttatttttcaactatgttttggggtttgggggtttttgttttgtattttgtagagagagttttgccgtgttgcacacactggtctcgaactcctgagctcaagcaatcacctcacctcaacctcccaaaatgctgggattacagacatgaaccaccatgcctggcctaattatgtattgtattgacttcttggcttactgctatttcttgcagcatgtatcctttttcttaaattttaaaaaattttgctatagtatattcctgaatgttgttttagtaattgtaatcttttcgtgtctgaaagagtgtctattttttcctcccactgaaatggttaattggc

SEQ ID NO: 1110 - DNA, 3016 bp; single-stranded, linear
  immediate source library: GENBANK
  immediate source clone: g1321593
gcacgagggaacaacctctctctctcagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctggaatttaagaaattcttaaagacaatgtcaaatatgatccaagagaaaatgtgatttgagtctggagacaattgtgcatatcgtctaataataaaaacccatactagcctatagaaaacaatatttgaataataaaaacccatactagcctatagaaaacaatatttgaaagattgctaccactaaaaagaaaactactacaacttgacaagactgctgcaaacttcaattggtcaccacaacttgacaaggttgctataaaacaagattgctacaacttctagtttatgttatacagcatatttcatttgggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgtttggtgcttctcctaactcaaggacttggacccatgactctgtagccagaagacttcaatattaaatgactttggggaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgatgaattcaaacaaatggctgtaaaactaaacatacatgttgggcatgattctacccttattcccccaagagacctagctaaggtctataaacatgaagggaaaattagcttttagttttaaaactctttatcccatcttgattggggcagttgactttttttttttcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcttacttctatatcattaggaaaacatcttagttgatgctacaaaacaccttgtcaacctcttcctgtcttaccaaacagtgggagggaattcctagctgtaaatataaattttgcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgct

SEQ ID NO: 1111 - DNA, 1903 bp; single-stranded, linear
  immediate source library: GENBANK
  immediate source clone: g1323695
gaattccagcaaatcttcagttggtggtaacacccttaccatgagccagatatgagatccctaatattctgtgatccctgatgagtgaagggaacaaggatatgtgtaggaggggagctcggtatgactaagggtcaagagaaggtgaggccagagagagcctgagctgagatctgctgaaacagctcctaaaatgaaaacaaggttggggccagaattttttctggatagtagttatgttttcctgccaacgctcaagtcctacacaaagacaaatgacaatcaatgtaaatgtcaaataagatcgttagcctgagtaatcataaccaatctgtatgacacctttttaacaggaggcctcattcttcttttccccaaccagaattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgctgaaacccggggaagtggccacagccagcatcttctttgggattctgtggttgttttctatcttcggcaattccctggtttgtttggtcatccataggagtaggaggactcagtctaccaccaactactttgtggtctccatggcatgtgctgaccttctcatcagcgttgccagcacgcctttcgtcctgctccagttcaccactggaaggtggacgctgggtagtgcaacgtgcaaggttgtgcgatattttcaatatctcactccaggtgtccagatctacgttctcctctccatctgcatagaccggttctacaccatcgtctatcctctgagcttcaaggtgtccagagaaaaagccaagaaaatgattgcggcatcgtggatctttgatgcaggctttgtgacccctgtgctctttttctatggctccaactgggacagtcattgtaactatttcctcccctcctcttgggaaggcactgcctacactgtcatccacttcttggtgggctttgtgattccatctgtcctcataattttattttaccaaaaggtcataaaatatatttggagaataggcacagatggccgaacggtgaggaggacaatgaacattgtccctcggacaaaagtgaaaactatcaagatgttcctcattttaaatctgttgtttttgctctcctggctgccttttcatgtagctcagctatggcacccccatgaacaagactataagaaaagttcccttgttttcacagctatcacatggatatcctttagttcttcagcctctaaacctactctgtattcaatttataatgccaattttcggagagggatgaaagagactttttgcatgtcctctatgaaatgttaccgaagcaatgcctatactatcacaacaagttcaaggatggccaaaaaaaactacgttggcatttcagaaatcccttccatggccaaaactattaccaaagactcgatctatgactcatttgacagagaagccaaggaaaaaaagcttgcttggcccattaactcaaatccaccaaatacttttgtctaagttctcattctttcaattgttatgcaccagagattaaaaagctttaactataaaaacagaagctatttacatatttgttttcactcaactttccaagggaaatgttttattttgtaaaatgcattcatttgtttactgtagtttttgtgggttttattttacttgctttttatgttttaggaaaagcgttcactttgaactttagccaacagtccttttactattaatatattagttacatgcataaaaaa

SEQ ID NO: 1112 - DNA, 1939 bp; single-stranded, linear
  immediate source library: GENBANK
  immediate source clone: g1326154
tgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttccctggcctcatcagtgatattcgtgagatgcaggaggcccgtaccctggcccgcgcccgtgcccatgctcgcgaccaagctcgtgaacaagaccgtgcccatgcctgtcctgctgtggaggaaaccccgatgaatgtccggaatgttccattacctggtgatgctgcagctggccaccccgaccgtgcctctggccaccctaagccccattccagatcctcctctgcctatcgcaaatctgcctctacccaccacaagtctgtctttagccactccaaggctgcctctggtcacctcaagcctgtctctggccactccaagcctgcctctggtcaccccaagtctgccactgtctaccctaagcctgcctctgtccatttcaagggtgactctgtccatttcaagggtgactctgtccatttcaagcctgactctgttcatttcaagcctgcttccagcaaccccaagcccatcactggccaccatgtctctgctggcagccactccaagtctgccttcagtgctgccaccagccaccctaaacccatcaagccagctaccagccatgctgagcccaccactgctgactatcccaagcctgccactaccagccaccctaagcccgctgctgctgacaaccctgagctctctgcctcccattgccccgagatccctgccattgcccaccctgtgtctgacgacagtgacctccctgagtcggcctctagccctgccgctgggcccaccaagcctgctgccagccagctggagtctgacaccatcgctgaccttcctgaccctactgtagtcactaccagtaccaatgattaccatgatgtcgtggttgttgatgttgaagatgatcctgatgaaatggctgtgtgaaaaatgctctcgtaggtggccaggcagt

SEQ ID NO: 1113 - DNA, 1578 bp; single-stranded, linear
  immediate source library: GENBANK
  immediate source clone: g1335855
gcgcccttaaagatggtgagggggctcatgctctgagtagaaggtggtgacctccaggagcggtgggatgatgagggcccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtgg

SEQ ID NO: 1114 - DNA, 945 bp; single-stranded, linear
  immediate source library: GENBANK
  immediate source clone: g1336040
atggaatttacagatagaaactacacgttggtcactgagtttattctattaggttttccaactcgccctgaactgcagattgtcctgttcctcatgtttctgacattgtatgctataattctgatagggaacattggattgatgctgttgatcaggattgatcctcaccttcaaacccccatgtattttttccttagcaacctatcatttgtagacctttgctatttctcagacattgttcccaaaatgctggtcaatttcctctcggagaacaaatctatttcctattatgggtgtgccctgcagttttattttttctgtacttttgcagatacagaatccttcatcctggccgccatggcctatgatcgctatgtcgccatctgtaaccctttattgtacacagttgtgatgtctaggggcatctgtatgcggttgattgtcttgtcataccttggaggcaacatgagttccctggttcacacatcctttgcctttattctgaaatattgtgacaaaaatgttattaatcattttttctgtgacctccctcccctgcttaaactatcctgcactgacacaacaattaatgagtggctcctctccacatacggcagctcagtggaaatcatttgttttatcatcatcatcatctcctactttttcattcttctctcagtcttaaagatccgctctttcagtgggaggaagaagaccttttctacatgcgcctctcacctgacttcagtgacgatctaccaagggactctcctctttatttactcacggcccagctacctgtattctccaaacactgataaaattatctcagtgttctacaccattttcattccagtgctgaatccgttgatttatagtttgagaaataaagatgtaaaggatgcagctgagaaagttctaagatcaaaggtagattcttcatga

SEQ ID NO: 1115 - DNA, 952 bp; single-stranded, linear
  immediate source library: GENBANK
  immediate source clone: g1336042
atgggaacagataaccagacttgggtgagtgaatttattctcctcggcctgtccagtgactgggacactcgggtctccctgtttgtcctgttcttggtcatgtatgtggtgaccgtgctggggaactgtctcattgtccttctgatcagactggacagccgactccacactcccatgtatttctttctcaccaacctctcccttgtcgatgtctcctatgccacaagtgtagtccctcagctgctggcacattttcttgcagaacataaagccatcccattccagagctgtgcagcccagttatttttctccctggccttgggtgggattgagtttgttctcctgcggtgatggcctatgaccgctatgtggctgtgtgtgatgccctcgatactcggccatcatgcatggagggctgtgtgctaggttggccatcacatcctgggtcagtggcttcatcagctctcctgtgcagactgctatcacctttcagctgcccatgtgcagaaacaagtttattgatcacatatcctgtgaactcctagctgtggtcaggctggcttgtgtggacacctcctccaatgaggtcaccatcatggtgtctagcattgttcttctgatgacacccctctgcctggttcttttgtcctacatccagatcatctccaccatcctaaagatccagtccagagaaggaagaaagaaagctttccacacgtgtgcctctcacctcacagtggttgccctgtgctatggtgtggccattttcacttacatccagccccactccagtccctctgtccttcaggagaagttgttctctgtcttttatgccattttaacaccaatgctgaaccccatgatttacagcctaaggaataaagaggtgaagggggcctggcagaaactattatggaaattctctgggttaacatcaaagctggcaacttga

SEQ ID NO: 1116 - DNA, 1831 bp; single-stranded, linear
  immediate source library: GENBANK
  immediate source clone: g1339917
gaattccgggctcgctcagctgctgcccagcctcggctgtgaggataggctggctgggcagcacgtctctccccacagggctccctgagaccaccaggaagagcccccaaccaatcttgggattctcccttcgtgcggttgtctgggacctttttccagggtcaaagcagatcgtgaggaggaagctgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaagtcctgtcctgcagggtgggatcagccctgccaggtgggccgccttcctggagacccgtagatgccagggctggaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaagggtgcccccaggctctcatgttcctggcgtgagatgaaaggatcctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggccccccagtagtgtgtcctggggacttcctcagagcgagaaacctccccccaatgtcttcaagacttttctctcccccccccccaaccccgtctctccctcccttgccacccaaatgttagaaaaatagctgtgaacagagagcgcttttgtctgcaatggcagcaggatctggacggtccggaattc

SEQ ID NO: 1117 - DNA, 1677 bp; single-stranded, linear
  immediate source library: GENBANK
  immediate source clone: g1370103
cgggggttttgatcttcttccccttcttttcttccccttcttctttccttcctccctccctctctcatttcccttctccttctccctcagtctccacattcaacattgacaagtccattcagaaaagcaagctgcttctggttgggcccagacctgccttgaggagcctgtagagttaaaaaatgaaccccacggatatagcagataccaccctcgatgaaagcatatacagcaattactatctgtatgaaagtatccccaagccttgcaccaaagaaggcatcaaggcatttggggagctcttcctgcccccactgtattccttggtttttgtatttggtctgcttggaaattctgtggtggttctggtcctgttcaaatacaagcggctcaggtccatgactgatgtgtacctgctcaaccttgccatctcggatctgctcttcgtgttttccctccctttttggggctactatgcagcagaccagtgggtttttgggctaggtctgtgcaagatgatttcctggatgtacttggtgggcttttacagtggcatattctttgtcatgctcatgagcattgatagatacctggcgatagtgcacgcggtgttttccttgagggcaaggaccttgacttatggggtcatcaccagtttggctacatggtcagtggctgtgttcgcctcccttcctggctttctgttcagcacttgttatactgagcgcaaccatacctactgcaaaaccaagtactctctcaactccacgacgtggaaggttctcagctccctggaaatcaacattctcggattggtgatccccttagggatcatgctgttttgctactccatgatcatcaggaccttgcagcattgtaaaaatgagaagaagaacaaggcggtgaagatgatctttgccgtggtggtcctcttccttgggttctggacaccttacaacatagtgctcttcctagagaccctggtggagctagaagtccttcaggactgcacctttgaaagatacttggactatgccatccaggccacagaaactctggcttttgttcactgctgccttaatcccatcatctacttttttctgggggagaaatttcgcaagtacatcctacagctcttcaaaacctgcaggggcctttttgtgctctgccaatactgtgggctcctccaaatttactctgctgacacccccagctcatcttacacgcagtccaccatggatcatgatcttcatgatgctctgtaggaaaaatgaaatggtgaaatgcagagtcaatgaacttttccacattcagagcttactttaaaattggtatttttaggtaagagatccctgagccagtgtcaggaggaaggcttacacccacagtggaaagacagcttctcatcctgcaggcagctttttctctcccactagacaagtccagcctggcaagggttcacctgggctgaggcatccttcctcacaccaggcttgcctgcaggcatgagtcagtctgatgagaactctgagcagtgcttgaatgaagttgtaggtaatattgcaaggcaaagactattcccttctaacctgaactgatgggtttctccagagggaattgcagagtactggctgatggagtaaatcgctaccttttgctgtggcaaatgggcccccg

SEQ ID NO: 1118 - DNA, 3021 bp; single-stranded, linear
  immediate source library: GENBANK
  immediate source clone: g1370110
gtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtggactctgcattgcccagtccgtgagaatcccccaggaacgcaaagacaggaccattgactttgatagaattatcaaacagctcctggacacccccaactccagggccgtcgtgatttttgccaacgatgaggatataaagcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactacgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagccctgctgcaaaaaagaagtatgtcagttataataacctggttatctaacctgttccattccatggaaccatggaggaggaaga

SEQ ID NO: 1119 - DNA, 3909 bp; single-stranded, linear
  immediate source library: GENBANK
  immediate source clone: g1373018
ggcacgaggctcgccgcggactcaagatggcggcgtgtggacgtgtacggaggatgttccgcttgtcggcggcgctgcatctgctgctgctattcgcggccgggggcagaaactccccggccagggcgtcccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccgcggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaaggacggaccctacactgtctgatgaaggtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatctcgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaagaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatatccaaatagaagccttgctgatgagagcctgtgagcccataattcagacattctgccacgatgcggataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagcactcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccacca

SEQ ID NO: 1120 - DNA, 4078 bp; single-stranded, linear
  immediate source library: GENBANK
  immediate source clone: g1377819
ccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagcttcagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttggatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgcgacctcctgggcaagaaggtgagtacaaagaccctatcggaagacgacctgaaggagatcccggccgagcagatggatttccgtgccaacctgcagcggcaagtgaagccaaagactgtgtctgaggaagagaggaaggtgcacagcccccaacaggtcgattttcgctccgtcctagccaagaaggggactcccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaatggaaagaccctcaagaccaccaagttcatcatcctctcccaggaaggctcactctgctccgtctccatcgagaaggcactgctcgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggacagcgagcacatcaaggtggagaacagcgagaatggcagcaagctcaccatcctggccgcgcgccaggagcactgcggctgctacacactgctggtggagaacaagctgggcagcaggca

SEQ ID NO: 1121 - DNA, 1077 bp; single-stranded, linear
  immediate source library: GENBANK
  immediate source clone: g1381668
atggatgtgacttcccaagcccggggcgtgggcctggagatgtacccaggcaccgcgcagcctgcggcccccaacaccacctcccccgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtgggggacctcatcctggtggccgactccctcattgaggtgttcaacctgcacgagcggtactacgacatcgccgtcctgtgcaccttcatgtcgctcttcctgcaggtgcaacatgtacaagcagcgtcttccttcctcacctggatgagcttcgaccgctacatcgccctggccagggccatgcgctgcagcctgttccgcaccaagcaccacgcccggctgagctgtgccctcatctggatgtcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtggactgcggccccggcgacagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaacccccctcatctacagctttctcggggagaccttcagggacaagctgaggctgtacattgagcagaaaacaaatttgccggccctgaaccgcttctgtcacgctgtcctgaaggtcgtcattccagacagcaccgagcagtcggatgtgaggttcagcagtgccgtgtga

SEQ ID NO: 1122 - DNA, 2254 bp; single-stranded, linear
  immediate source library: GENBANK
  immediate source clone: g1381807
caaccatatccaagcctttgcccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaacccttggccaatgagaccttttgtggccaaggacaacaaagatcctgtgcacagtgcaccactngggaggacttccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaagggggaggacttctactgcgtgacttgccatgagaccaagttggccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaacttcgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaagggcatttgaatctcgttctttgtgtccttactttctgccctataccatcaataggggaagagtggtccttcccttctttaaagttcctcccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcccaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaat

SEQ ID NO: 1123 - DNA, 1378 bp; single-stranded, linear
  immediate source library: GENBANK
  immediate source clone: g1387999
ctccgaggaggggtggggacggtcctgacggtggggacatcaggctgccccgcagtaccagggagcgacttgaagtgcccatgccgcttgctccgggagaagcccaggtgtggcctcactcacatcccactctgagtccaaatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagg

SEQ ID NO: 1124 - DNA, 921 bp; single-stranded, linear
  immediate source library: GENBANK
  immediate source clone: g1388194
ccctcggacggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggcgtggtccacggtacttgaagaagccagagcccacatcctgtgcactgctgaaggaccctacgctcggtggcctggcacctcactttgagaagagtgagcacactggctttgcatcctggaaggcctgcagggggcggggcaggaaatgtacctgaaaaggattttagaaaaccctgggaaacccaccacaccaccacaaaatggcctttagtgtatgaaatgcacatggaggggatgtagttgcatttttgctaaaaaaaaaaaaaa

SEQ ID NO: 1125 - DNA, 2880 bp; single-stranded, linear
  immediate source library: GENBANK
  immediate source clone: g1389852
tggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccagggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagtaaaaaaaaaaaaaaaa

SEQ ID NO: 1126 - DNA, 2254 bp; single-stranded, linear
  immediate source library: GENBANK
  immediate source clone: g1399100
gctggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagaaacagtctgcgttctgtggtggggataagaagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaa

SEQ ID NO: 1127 - DNA, 1496 bp; single-stranded, linear
  immediate source library: GENBANK
  immediate source clone: g1399104
gcacgaggcctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctcaaaaaaaaaaaaaaaaaaaaaaaaa

SEQ ID NO: 1128 - DNA, 1798 bp; single-stranded, linear
  immediate source library: GENBANK
  immediate source clone: g1399196
agacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgcaaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcg

SEQ ID NO: 1129 - DNA, 3722 bp; single-stranded, linear
  immediate source library: GENBANK
  immediate source clone: g1399211
acgaggcagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagat

SEQ ID NO: 1130 - DNA, 1718 bp; single-stranded, linear
  immediate source library: GENBANK
  immediate source clone: g1399461
ggtcggaggagcagatcacgcttgcgaaggcggtctcgatcacgcggtggtcgtagacgaaggagcagaagcaaagtaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaagcttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagatgaagaaatttcacagcagtttcattaatgtatataaacttataaatatttctccagcaaatttgaggaagca

SEQ ID NO: 1131 - DNA, 1102 bp; single-stranded, linear
  immediate source library: GENBANK
  immediate source clone: g1405318
gcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatactaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtg

SEQ ID NO: 1132 - DNA, 4078 bp; single-stranded, linear
  immediate source library: GENBANK
  immediate source clone: g1407624
gaattccgggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggcgtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactaccacccctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccaggccgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagaggcgcgaggcccgcgggcgccgcagcatcaaggacgtcatgctggccgatgcccaggagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagcccgggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcaggccggctgagccgggcgcggagaacgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgac

SEQ ID NO: 1133 - DNA, 4078 bp; single-stranded, linear
  immediate source library: GENBANK
  immediate source clone: g1408051
acaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggcggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaatatgccaagggaccccttaatggaaacacagatcagtagtgctatctcatgacaaccacaagaaaccgacgacaaatcttttgcgagattttcttctagtggcttagaaacatggcttttaagaaacacggtgatatctttgagggtgacaaggcgtctcttcaaacagttccataccaactgctttgctctagggaagcagtgcgtgtgaaacagcgtaacggagggtgaagagcatagttaataagcaactgtaaaaagttttatttgtttactttaatt

SEQ ID NO: 1134 - DNA, 4078 bp; single-stranded, linear
  immediate source library: GENBANK
  immediate source clone: g1418931
atggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagctccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagtcccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactacccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaa

SEQ ID NO: 1135 - DNA, 2109 bp; single-stranded, linear
  immediate source library: GENBANK
  immediate source clone: g1418933
ccagcctcggagggagggattagaagccgctagactttttttcctcccctctcagtagcacggagtccgaattaattggatttcattcactggggaggaacaaaaactatctgggcagcttcattgagagagattcattgacactaagagccagcgctgcagctggtgcagagagaacctccggctttgacttctgtctcgtctgccccaaggccgctagcctcggcttgggaaggcgaggcggaattaaaccccgctccgagagcgcacgttcgcgcgcggtgcgtcggccattgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaa

SEQ ID NO: 1136 - DNA, 1518 bp; single-stranded, linear
  immediate source library: GENBANK
  immediate source clone: g1432176
atgggtgaaactctgggagattctcctattgacccagaaagcgattccttcactgatacactgtctgcaaacatatcacaagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactag

SEQ ID NO: 1137 - DNA, 1418 bp; single-stranded, linear
  immediate source library: GENBANK
  immediate source clone: g1438903
gtaatgtttttttggttgctgacaaatgtctttttattccaagcaggactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaa

SEQ ID NO: 1138 - DNA, 3071 bp; single-stranded, linear
  immediate source library: GENBANK
  immediate source clone: g1463025
aaaagcaactgaggtcttaactttcagacgctgaattctcatctaattgaaattactgggcataatgctatatatagccaatgaagagattttgagctctcactcagtgccttcaagacatgtcgttttgtagtcagagaaaacagagatcaatgcattttcaaactgacagagggaacggatgctctttagtagcacatgcccaggatcgtgtgtgtggggcttgcgctgtgctgagaagctgaataccggtccatatgctccttatttactgcaatgttctttgcatgttactgtgcactccggactaacgtgaagaagtatcgatatcaagatgaggacgctccacatgatcattccttacctcgactaacccacgaagtaagaggcccagaactcgtgcatgtatcagaaaagaacctctctcaaatagaaaatgtccatggatatgtcctgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgctcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaccccactaccatttatatgactgatccttatggtccacctgatattactcactcttattctccaccaatggaaaaccatctactctctggcaacaatggcactttagaatataaaacctccctgccacccatctctccagggaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgtggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaatctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtg

SEQ ID NO: 1139 - DNA, 1365 bp; single-stranded, linear
  immediate source library: GENBANK
  immediate source clone: g1463130
ttgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaac

SEQ ID NO: 1140 - DNA, 2180 bp; single-stranded, linear
  immediate source library: GENBANK
  immediate source clone: g1469305
gtgaaattctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgggcgcccatcagggtgcccgcctggcacttgacgagcacgttcaattcctggtttaccagctgctgcgcgggctgaagtacatccactcggccgggatcatccaccgggacctgaagcccagcaacgtggctgtgaacgaggactgtgagctcaggatcctggatttcgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcggaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtccttagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgtatgcatgcacaaacatgtgtgtacatgtgcttgccatgtgtaggagtctgggcacaagtgtccctgggcctaccttggtcctcctgtcctcttctggctactgcactctccactgggacctgactgtggggtcctagatgccaaaggggttcccctgcggagttcccctgtctgtcccaggccgacccaagggagtgtcagccttgggctctcttctgtcccagggctttctggagggcgcgctggggccgggaccccgggagactcaaagggagaggtctcagtggttagagctgctcagcctggaggtagggcgctgtcttggtcactgctgagacccacaggtctaagaggagaggcagagccagtgtgccaccaggctgggcagggacaaccaccaggtgtcaaatgagaaaagctgcctggagtcttgtgttcacccgtgggtgtgtgtgggcacgtgtggatgagcgtgcactccccgtgttcatatgtcagggcacatgtgatgtggtgcgtgtgaatctgtgggcgcccaaggccagcagccatatctggcaagaagctggagccggggtgggtgtgctgttgccttccctctcctcggttcctgatgccttgaggggtgtttcagactggcggcaccgttgtggccctgcagccggagatctgaggtgctctggtctgtgggtcagtcctctttccttgtcccaggatggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaataaagggggttctctctcagaaaaaaa

SEQ ID NO: 1141 - DNA, 771 bp; single-stranded, linear
  immediate source library: GENBANK
  immediate source clone: g1469897
gggcagatgagttgaggaaaacttaactgatacagttgtgccagaagccaaaataagaggcgtgccctttctatagccccattaaaagaacaaaaaagtggaagcatcttcagtgaatatgggtcagcacctcccagacctcagggagtccacttctgttcatcccagcacccagcattgcatatccagattatttgagcccaatctcttatcctctgaagaacacaatcggctttggggccacagaaggtttaggtagtggtttagggatttctaatcccaaactttgtccttgggaggtttaggattagtattgatcattcacagagcccaagtgtttttagaggaggggttttgtggggtgggaggatcacctataagaggactcagaggagggtgtggggcatccatgagaaaaatgtcggaggaagagttttatctgttcaaaaatatctcttcagtggggccgtgggatgggcctcagtaccacattgcccctgtctgggccttctacctccaggcagctttcatgggcactgtcttccttatagggttcccactcaatgccatggtgctggtggccacactgcgctacaaaaagttgcggcagcccctcaactacattctggtcaacgtgtccttcggaggcttcctcctctgcatcttctctgtcttccctgtcttcgtcgccagctgtaacggatacttcgtcttcggtcgccatgtttgtgctttggagggcttcctgggcactgtagcaggtactgcagg

SEQ ID NO: 1142 - DNA, 2121 bp; single-stranded, linear
  immediate source library: GENBANK
  immediate source clone: g1477788
cggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaccaatttatacttatgcagggagctatggggtacattccttgatttcaggatagttttttcaaataggaaa

SEQ ID NO: 1143 - DNA, 2885 bp; single-stranded, linear
  immediate source library: GENBANK
  immediate source clone: g1478280
cggcacgcccgggaggctttctctggctggtaaccgctactcccggacaccagaccaccgccttccgtacacaggggcccgcatcccaccctcccggacctaagagcctgggtcccctgtttccggagtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagccaccgccaacgggggcctggcagctggcctccatcgaggaccaaggcgcggcagcaggcggctactgcggttcccgggacctggtgcgccgctgccttcgagccaacctgcttgtgctgctgacagtggtggccgtggtggccggcgtggcgctgggactgggggtgtcgggggccgggggtgcgctggcgttgggcccgggagcgcttgaggccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattatgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactattaaaaaaaaaaaaaaaaaa

SEQ ID NO: 1144 - DNA, 1176 bp; single-stranded, linear
  immediate source library: GENBANK
  immediate source clone: g1478492
cctcgagagctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggcaatcctccgccaagctcgagagcccaggcaagctgtgattgtcacaaggaagctgactccagaggccatgcctgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctag

SEQ ID NO: 1145 - DNA, 2588 bp; single-stranded, linear
  immediate source library: GENBANK
  immediate source clone: g1479978
gctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacag

SEQ ID NO: 1146 - DNA, 1302 bp; single-stranded, linear
  immediate source library: GENBANK
  immediate source clone: g1480860
atggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtga

SEQ ID NO: 1147 - DNA, 2169 bp; single-stranded, linear
  immediate source library: GENBANK
  immediate source clone: g1488262
ccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaagcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagctttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcttaggacccaagccctgaaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccagggggcctcctcctaggataataaacaattttgca

SEQ ID NO: 1148 - DNA, 1101 bp; single-stranded, linear
  immediate source library: GENBANK
  immediate source clone: g1504140
atgtggaacgcgacgcccagcgaagagccggggttcaacctcacactggccgacctggactgggatgcttcccccggcaacgactcgctgggcgacgagctgctgcagctcttccccgcgccgctgctggcgggcgtcacagccacctgcgtggcactcttcgtggtgggtatcgctggcaacctgctcaccatgctggtggtgtcgcgcttccgcgagctgcgcaccaccaccaacctctacctgtccagcatggccttctccgatctgctcatcttcctctgcatgcccctggacctcgttcgcctctggcagtaccggccctggaacttcggcgacctcctctgcaaactcttccaattcgtcagtgagagctgcacctacgccacggtgctcaccatcacagcgctgagcgtcgagcgctacttcgccatctgcttcccactccgggccaaggtggtggtcaccaaggggcgggtgaagctggtcatcttcgtcatctgggccgtggccttctgcagcgccgggcccatcttcgtgctagtcggggtggagcacgagaacggcaccgacccttgggacaccaacgagtgccgccccaccgagtttgcggtgcgctctggactgctcacggtcatggtgtgggtgtccagcatcttcttcttccttcctgtcttctgtctcacggtcctctacagtctcatcggcaggaagctgtggcggaggaggcgcggcgatgctgtcgtgggtgcctcgctcagggaccagaaccacaagcaaaccgtgaaaatgctggctgtagtggtgtttgccttcatcctctgctggctccccttccacgtagggcgatatttattttccaaatcctttgagcctggctccttggagattgctcagatcagccagtactgcaacctcgtgtcctttgtcctcttctacctcagtgctgccatcaaccccattctgtacaacatcatgtccaagaagtaccgggtggcagtgttcagacttctgggattcgaacccttctcccagagaaagctctccactctgaaagatgaaagttctcgggcctggacagaatctagtattaatacatga

SEQ ID NO: 1149 - DNA, 1634 bp; single-stranded, linear
  immediate source library: GENBANK
  immediate source clone: g1514596
tcccatcttttcctcgcattttttcaccatctttccctcaatctccaggagccaatgcgagacttttggctccgattaagcgacggcccgagacttggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataagttatgatagct

SEQ ID NO: 1150 - DNA, 2211 bp; single-stranded, linear
  immediate source library: GENBANK
  immediate source clone: g1518529
ggcgctgcggagggagggggcggcccggcccggcccagctctgcccccggccggcccgaccccggccccggcccccggacaagcccttatctgatcccagctccgggtttaagagtcctggcccggcccgtcgcacagctctgctcctaactcctgcccgccccgtccgtccatctgtcccgctgccccgcggcccatccaagggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcccctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttccaggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctctttgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaagcacccatcctccactccctcttctttaacccagtggcctgttggtagcttaggccaactggagtccaggttcgcctcccactgtcccctttccacttccccagcttctgccccaatacacatacctcccttaagccaggatgggggaaagagtgggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctgacggattcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaaacctatcttccaggcagcccagagaagatctgtttccctgtgtcctgtgaatggaaggacccgagcc

SEQ ID NO: 1151 - DNA, 1614 bp; single-stranded, linear
  immediate source library: GENBANK
  immediate source clone: g1524087
atggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtg

SEQ ID NO: 1152 - DNA, 4078 bp; single-stranded, linear
  immediate source library: GENBANK
  immediate source clone: g1524091
ggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtacgagaaggtgggagaggccacggagacagctctgacttgcctggtggagaagatgaatgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctaccggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagatggcctacctgccacggctctgggcttcaacccgccagacctggacatcatagagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagggtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggccggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgct

SEQ ID NO: 1153 - DNA, 3056 bp; single-stranded, linear
  immediate source library: GENBANK
  immediate source clone: g1524108
gcggggcgggccggcggcggaggccgggccgcggagccaggagtgactagcagcagttggccgtgccgtagcagcgtcccgcgcgcggcgggcagcggcccaggaggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaaaaacttcaccagttcaaaaaaaaaaaaaaaaaaaaa

SEQ ID NO: 1154 - DNA, 4078 bp; single-stranded, linear
  immediate source library: GENBANK
  immediate source clone: g1526977
cgcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggaaattcatgatgaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcgcaagaagcaatggtggacaagttggcagaaaatgcacataatgtgtgggcgcgggatcgaatccggcagggctggacttatggcatccaacaggacgtaaagaacagaagaaatcctcgccttgttccctacactcctctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggct

SEQ ID NO: 1155 - DNA, 3036 bp; single-stranded, linear
  immediate source library: GENBANK
  immediate source clone: g1526989
gctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatccagcacctattgaattaccatagagtaatgatgtaacagtgcaagatttttttttttaagtgacataattgtccagttataagcgtatttagactgtggccatatatgctgtatttctttgtagaataaatggtttctcattaaactctaaagattagggaaatggatatagaaaatcttagtatagtagaaagacatctgcctgtaattaaactagtttaagggtggaaaaatgaaaatttttgctaattatcaatgggatatgattggttcagttttttttttccagagttgttgtttgccaagctaatctgcctggtttatttatatcttgttattaatgtttcttctccaattctgaaatacttttgagtatggctatctatacctgccttttaagtttgaaactaactcatagatgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttcctcctttttattcagctagaatttctggtgggttgatggtagggtataatgtgtctgtgttgcttcaaattggtctgaaaggctatcctgctgaaagtcctgctttcctatctagcatttattcctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattatgttcttacaagcttaaagcttgatttgatct

SEQ ID NO: 1156 - DNA, 813 bp; single-stranded, linear
  immediate source library: GENBANK
  immediate source clone: g1531982
accaaaccagaaacctccacttctcacgccaaagctcacaccttcagcctccaacatgaaggtctccgcagcacttctgtggctgctgctcatagcagctgccttcagcccccaggggctcactgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaggtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatatatatttttttttaaaaaaaaacgtattgcatttaatttattgaggctttaaaacttatcctccatgaatatcagttacttttaaactgtaaagctttgtgcagattctttaccccctgggagccccaattcgatcccctgtcacgtgtgggcaatgttccccctctcctctcttcctccctggaatctttaaaggtcctggcaaagatgatcagtatgaaaatgtcattgttcttgtgaacccaaagtgtgactcattaaatggaagtaaatgttgttttaggaatacataaagtatgtgcatatttaaaaaaaaaaaaaaaaaaaaaaaaaaaa

SEQ ID NO: 1157 - DNA, 2218 bp; single-stranded, linear
  immediate source library: GENBANK
  immediate source clone: g1546083
acgagactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaacagaaaaaaaaaaaaaaaaaaaaaaaaaaaaaaaaaaaaaaaaaaaaaaaaaaaaaaaaaaaaaaaaaaaaaa

SEQ ID NO: 1158 - DNA, 467 bp; single-stranded, linear
  immediate source library: GENBANK
  immediate source clone: g1575003
ggggagtggaggcagcccattcacctggggaaatgactgggttgtcgatggacggtggcggcagccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaacgcctgcctcgtgccacctcatgcttataataaagccggcgtcagagaccgctgcttccctc

SEQ ID NO: 1159 - DNA, 912 bp; single-stranded, linear
  immediate source library: GENBANK
  immediate source clone: g1575791
ggcacgagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcggggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgcc

SEQ ID NO: 1160 - DNA, 1095 bp; single-stranded, linear
  immediate source library: GENBANK
  immediate source clone: g1613843
atgacaagacctggacaaccagcacttaccagagtgcccccacctattcttccaaggccatcacagcagacaggaagtagcagtgtgaacacttttagacctgcttacagttcattttcttctggatatggtgcctatggaaattcattttatggaggctatagtccttatagttatggatataatgggctgggctacaaccgcctccgtgtagatgatcttccacccagtagatttgttcagcaagctgaagaaagcagcaggggtgcatttcagtccattgaaagtattgtgcatgcatttgcctctgtcagtatgatgatggatgctaccttttcagctgtctataacagtttcagggctgtattggatgtagcaaatcacttttcccgattgaaaatacactttacaaaagtgttttcagcttttgcattggttaggactatacggtatctttacagacggctacagcggatgttaggtttaagaagaggctctgagaatgaagacctctgggcagagagtgaaggaactgtggcatgccttggtgctgaggaccgagcagctacctcagcaaaatcttggccaatattcttgttctttgctgttatccttggtggtccttacctcatttggaaactattgtctactcacagtgatgaagtaacagacagcatcaactgggcaagtggtgaggatgaccatgtagttgccagagcagaatatgattttgctgccgtatctgaagaagaaatttctttccgggctggtgatatgctgaacttagctctcaaagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttga

SEQ ID NO: 1161 - DNA, 1864 bp; single-stranded, linear
  immediate source library: GENBANK
  immediate source clone: g1621456
tcggcacgaggggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacgagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacc

SEQ ID NO: 1162 - DNA, 3033 bp; single-stranded, linear
  immediate source library: GENBANK
  immediate source clone: g1638834
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgatcgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcacgtgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgcccatgctaccctccccgcctccctccacagtgatcagctgttgacctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcaccc

SEQ ID NO: 1163 - DNA, 2897 bp; single-stranded, linear
  immediate source library: GENBANK
  immediate source clone: g1655914
ggaattccgcgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggtggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaattttttttttgaatgggatgtcctatggaaacctatttcaccagagttttaaaaataaaaagggtattgttttgtcttctgtaaaaaaaaaaaaaaaaaaaaaaaaaaaaaaaaaaaaaaaaaaa

SEQ ID NO: 1164 - DNA, 1217 bp; single-stranded, linear
  immediate source library: GENBANK
  immediate source clone: g1679601
ctgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgtcagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgatcactctgtggtttag

SEQ ID NO: 1165 - DNA, 987 bp; single-stranded, linear
  immediate source library: GENBANK
  immediate source clone: g1694672
cagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtc

SEQ ID NO: 1166 - DNA, 2513 bp; single-stranded, linear
  immediate source library: GENBANK
  immediate source clone: g1698719
cggggaaaaggcttgtgaacggcgtttctgcgtctgccgtggacagcgaagtctgcggttcctgagccggagtttgcgccggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcagtatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtggaagtttaagaaattgaaaaaaaaaaaagaatcagcactcaggtctttttcttcagaaatgaagacaaaatttaaaatatggaatgatgcagaatagttttttccctattgactgtcagaaaatccactgggaaatgtaaaaatcttcactcaccattatgatatttatcttgaaagaaatggtgtcatacctgcctagaaactgaaattttaaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatgctaagagcctcaaaatgaaccataagtctcagataagaagtgatggtgataaacatcaaaaagtgaatggaacaccttgattggggaagatatgcaaatactttgatctaagaattgaaatgtatcaagaatttatattttgcctgcagaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaagcattttctaccgacaaggcactgtgctaggtactgtaatctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggaggaggaccggaattc

SEQ ID NO: 1167 - DNA, 545 bp; single-stranded, linear
  immediate source library: GENBANK
  immediate source clone: g1703639
gagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgttaaaaaaaaaaaaaaaaaa

SEQ ID NO: 1168 - DNA, 1921 bp; single-stranded, linear
  immediate source library: GENBANK
  immediate source clone: g1710134
ccccgcgcgagagcggcccttgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaagaagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagtttaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatacttaactgaagcttcggccgcaccacccggggaagggtcctcttttcctggcagctgctgtgggtggggcccagacaccagcctagcctgctctgccccgcagacggtctgtgtgctgtttgaaaataaatcttagtgttcaaaacaaaatgaaacaaaaaaaaaaatgataaaaactctcaaaaaaacaaggaattc

SEQ ID NO: 1169 - DNA, 1957 bp; single-stranded, linear
  immediate source library: GENBANK
  immediate source clone: g1731789
ttgatagggatagaaacacatttggctgcttctatagttaacaagatgctgttacattccttgcctcactagctctgaagactatactagcgggacaaagaaagcacctgagatgagctgagaggagggtaaaggtacacagagatcccctggatatttgttctatgtcctctcaggggctttgctaccactagagaattatccatattaagaacttgcattgatattctgggttctgtttcattttttagggtctcaagagcacgctcaagtcattcacatgtttccatcaaatacagacacagatcagggaagattaaaccctactaatttctcgtcggatgcctcacaacaaggtgccttccaagaactaatggccaaaatatccacccacaacacaaataagcttagaaaatctcttcttacaatcctgacacaatggaagtttccctaaaccacccagcatctaatacaaccagcacaaagaacaacaactcggcatttttttactttgagtcctgtcaacctccttctccagctttactcctattatgcatagcctatactgtggtcttaattgtgggcctttttggaaacctctctctcatcatcatcatctttaagaagcagagaaaagctcagaatttcaccagcatactgattgccaatctctccctctctgataccttggtgtgtgtcatgtgcatccattttactatcatctacactctgatggaccactggatatttggggataccatgtgcagactcacatcctatgtgcagagtgtctcaatctctgtgtccatattctcacttgtattcactgctgtcgaaagatatcagctaattgtgaacccccgtggctggaagcccagtgtgactcatgcctactggggcatcacactgatttggctgttttcccttctgctgtctattcccttcttcctgtcctaccacctcactgatgagcccttccgcaacctctctctccccactgacctctacacccaccaggtggcctgtgtggagaactggccctccaaaaaggaccggctgctcttcaccacctccctttttctgctgcagtattttgttcctctaggcttcatcctcatctgctacttgaagattgttatctgcctccgcaggagaaatgcaaaggtagataagaagaaggaaaatgagggccggctcaatgagaacaagaggatcaacacaatgttgatttccatcgtggtgacctttggagcctgctggctgccccgaatatcttcaatgtcatctttgactggtatcatgaggtgctgatgagctgccaccacgacctggtatttgtagtttgccacttggttgctatggtttccacatgtataaaccctctcttttatggctttctcaacaaaaatttccaaaaggacctggtagtgcttattcaccactgctggtgcttcacacctcaggaaagatgtgaaaatattgccatctccactatgcacacagactccaagaggtctttaagattggctcgtataacaacaggtatatgaaaattgataatgctgaagctcttcttgaatgggagctggacaggtaatggtgggaatagggcaagatgcagaaagaagaaaccagaaccaaaaatagcaactttatacccacttttcctttaggctaagactgcctgtctcatatgtctatccaacacaccctccaacatacacgaacacacataccaccccttttctcttaagaaaataactctaataattcaaacaacctgcccgccatcatttgtggcaaagaatgagaatgagaaagcagagagagaggcaaacagcagtgatggctggggaacaatgttcacagatacttttattcaatggaatatctacaaaagttatgactaatgatatgcctagtaaaaacactgctatacctccttagcactgagaat

SEQ ID NO: 1170 - DNA, 1506 bp; single-stranded, linear
  immediate source library: GENBANK
  immediate source clone: g177771
agaccttaactaccagctggtagttgtctcagcattcttcaaatagtccggtcttgtttaatattattattattattgttatttaattttattttattgcaactgtacttagagaatagtctggttcttgagaccttttcactgtggtctgttctggtgtacggctcccaccagtgtgaagcagaaggatgactttgctctgttgtcaggacaaccttgaaggaaggagccaaatgtgtggaggtctgtgggaagagagagccacctagcatgtccccactgaaccagtcagcagaaggccttccccaggaggcctccaacagatccctgaatgccacagaaacctcagaggcttgggatcccaggaccctccaggcgctcaagatctcccttgccgtggtcctttccgtcatcacactggccacagtcctctccaatgcctttgtactcaccaccatcttactcaccaggaagctccacacccctgccaactacctgattggctccctggccaccaccgacctcttggtttccatcttggtaatgcccatcagcatcgcctataccatcacccacacctggaactttggccaaatcttgtgtgacatctggctgtcctctgacatcacgtgctgcacagcctccatcctgcatctctgtgtcattgctctggacaggtactgggcaatcacagatgccctggaatacagtaaacgcaggacggctggccacgcggccaccatgatcgccattgtctgggccatctccatctgcatctccatccccccgctcttctggcggcaggccaaggcccaggaggagatgtcggactgtctggtgaacacctctcagatctcctacaccatctactccacctgtggggccttctacattccctcggtgttgctcatcatcctatatggccggatctaccgggctgcccggaaccgcatcctgaatccaccctcactctatgggaagcgcttcaccacggcccacctcatcacaggctctgccgggtcctcgctctgctcgctcaactccagcctccatgaggggcactcgcactcggctggctcccctctctttttcaaccacgtgaaaatcaagcttgctgacagtgccctggaacgcaagaggatttctgctgctcgagaaaggaaagccactaaaatcctgggcatcattctgggggcctttatcatctgctggctgcccttcttcgtggtgtctctggtcctccccatctgccgggactcctgctggatccacccggcgctctttgacttcttcacctggctaggctatttaaactccctcatcaatccaataatctacactgtgtttaatgaagagtttcggcaagcttttcagaaaattgtccctttccggaaggcctcctagtcttattcggtgatgactcttgttatcttttgtgtcctgtaacctcatcgggattgtcttttttttttttaattattttctgagacttggattaattcatgg

SEQ ID NO: 1171 - DNA, 1930 bp; single-stranded, linear
  immediate source library: GENBANK
  immediate source clone: g177773
atcgaatgttgagagaagcagtgctctgatccagctcaggagaaaaaggagcgggttccgagtgagacttctggagccagctggacgtgccggtttgcccagtgcggcgcggctgcacgcaccgtccacaagagtctcagtcgcccaggctggagtgcagcagcacagtctcacctcattgcaacctccgcctcccgggttcgcgggttctccgcctcagcttcctagtagctgggattgcaggcactcaccaccatgcccggctaattttttgaatttttagtggagacgggatttcaccatgttggccatgctggtcttgaacccccgacctcggatgattcgcccgcctcggcctcccaaagtgctggaattacaggcgaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacaaaaaaaaaaaaaaaaaaaa

SEQ ID NO: 1172 - DNA, 2002 bp; single-stranded, linear
  immediate source library: GENBANK
  immediate source clone: g177806
cccgtgcaggggccctacggacaccaccagggctacgacccagagcagggccaggatggcggccgccttgcgctcggtcatgatggctgggtacttgagtgagtggcgcacgcccacgtaccggtccacggagatggtgcagaggctgaggatggaggccgtgcagcacagcacgtccacggcggccgtcgggggactggtggtgagcgcgcagggcgtgggcgtgggcgtcttcctggcagccttcatccttatggccgtggcaggtaacctgcttgtcatcctctcagtggcctgcaaccgccacctgcagaccgtcaccaactatttcatcgtgaacctggccgtggccgacctgctgctgagcgccaccgtactgcccttctcggccaccatggaggttctgggcttctgggcctttggccgcgccttctgcgacgtatgggccgccgtggacgtgctgtgctgcacggcctccatcctcagcctctgcaccatctccgtggaccggtacgtgggcgtgcgccactcactcaagtacccagccatcatgaccgagcgcaaggcggccgccatcctggccctgctctgggtcgtagccctggtggtgtccgtagggcccctgctgggctggaaggagcccgtgccccctgacgagcgcttctgcggtatcaccgaggaggcgggctacgctgtcttctcctccgtgtgctccttctacctgcccatggcggtcatcgtggtcatgtactgccgcgtgtacgtggtcgcgcgcagcaccacgcgcagcctcgaggcaggcgtcaagcgcgagcgaggcaaggcctccgaggtggtgctgcgcatccactgtcgcggcgcggccacgggcgccgacggggcgcacggcatgcgcagcgccaagggccacaccttccgcagctcgctctccgtgcgcctgctcaagttctcccgtgagaagaaagcggccaagactctggccatcgtcgtgggtgtcttcgtgctctgctggttccctttcttctttgtcctgccgctcggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaagccacccagcgccttccgcgagtggaggctgctggggccgttccggagacccacgacccagctgcgcgccaaagtctccagcctgtcgcacaagatcgccgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaaggaccccagagctaggccgcggagtgtgctgggcttgggggtaagggggaccagagaggcgggctggtgttctaagagcccccgtgcaaatcggagacccggaaactgatcagggcagctgctctgtgacatccctgaggaactgggcagagcttgaggctggagcccttgaaaggtgaaaagtagtggggccccctgctggactcaggtgcccagaactcttttcttagaagggagaggctgcgggctccgtggggccttttgctcccaatccctatttgagaaacactgccccatcctccatgccctgaaccctgagtagacagccccaagcatggccaggaaggcctgcccc

SEQ ID NO: 1173 - DNA, 4079 bp; single-stranded, linear
  immediate source library: GENBANK
  immediate source clone: g177865
tgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatcc

SEQ ID NO: 1174 - DNA, 4079 bp; single-stranded, linear
  immediate source library: GENBANK
  immediate source clone: g177869
gctacaatccatctggtctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaacgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttttattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggggtggctgaggtaggagtaacagtccctgacaccatcaccgagtggaaggcaggggccttctgcctgtctgaagatgctggacttggtatctcttccactgcctctctccgagccttccagcccttctttgtggagcttacaatgccttactctgtgattcgtggagaggccttcacactcaaggccacggtcctaaactaccttcccaaatgcatccgggtcagtgtgcagctggaagcctctcccgccttccttgctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagaggtcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagccgccacatttaccaggactgggaaggctgcacaggtgactatccagtcttcagggacattttccagcaaattccaagtggacaacaacaatcgcctgttactgcagcaggtctcattgccagagctgcctggggaatacagcatgaaagtgacaggagaaggatgtgtctacctccagacctccttgaaatacaatattctcccagaaaaggaagagttcccctttgctttaggagtgc

SEQ ID NO: 1175 - DNA, 1493 bp; single-stranded, linear
  immediate source library: GENBANK
  immediate source clone: g177889
aattccggttgaaaccatccctcagctcctagagggagattgttagatcatgaaactaattaccatccttttcctctgctccaggctactactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttc

SEQ ID NO: 1176 - DNA, 2261 bp; single-stranded, linear
  immediate source library: GENBANK
  immediate source clone: g177987
cccgggaggcggacgttgtagagagctgagatcgcaccactgcactccagcctgggtgacaaagcgagattctgtctcaaaaaaaaaaaaaaaaaaaaaaaaactataaacaatggatggacaagaaaatcatgctggtgtgcgaagctaatgtgtttccctctcttccagatgctggccaagaagagctgaaataagaaaacagcctagaacctaacactatttactgtaaaaatttttgcaccaggatggaaggggattcttaccacaatgcaaccaccgtcaatggcaccccagtaaatcaccagcctttggaacgccacaggttgtgggaagtcatcaccattgcagctgtgactgctgtggtaagcctgatcaccattgtgggcaatgtcttggtcatgatctccttcaaagtcaacagccagctcaagacagttaacaactattacctgctcagcttagcctgtgcagatctcatcattggaatcttctccatgaacctctacaccacctacatcctcatgggacgctgggctctcgggagtctggcttgtgacctttggcttgcactggactacgtggccagcaacgcttctgtcatgaaccttctggtgatcagttttgaccgttacttttccatcacaagacccttgacatatcgggccaagcgtactccgaaaagggctggcatcatgattggcttggcctggctgatctccttcatcctctgggccccagcaatcctctgctggcagtacttggttgggaagcggacagttccactggatgagtgccagatccagtttctctctgagcccaccatcacttttggcactgccattgctgccttctacatccctgtttctgtcatgaccatcctctactgtcgaatctaccgggaaacagagaagcgaaccaaggacctggctgacctccagggttctgactctgtgaccaaagctgagaagagaaagccagctcatagggctctgttcagatcctgcttgcgctgtcctcgacccaccctggcccagcgggaaaggaaccaggcctcctggtcatcctcccgcaggagcacctccaccactgggaagccatcccaagccactggcccaagcgccaattgggccaaagctgagcagctcaccacctgtagcagctacccttcctcagaggatgaggacaagcccgccactgaccctgtcctccaagtggtctacaagagtcagggtaaggaaagcccaggggaagaattcagtgctgaagagactgaggaaacttttgtgaaagctgaaactgaaaaaagtgactatgacaccccaaactaccttctgtctccagcagctgctcatagacccaagagtcagaaatgtgtggcctataagttccgattggtggtaaaagctgacgggaaccaggagaccaacaatggctgtcacaaggtgaaaatcatgccctgccccttcccagtggccaaggaaccttcaacgaaaggcctcaatcccaaccccagccatcaaatgaccaaacgaaagagagtggtcctagtcaaagagaggaaagcagcccagacactgagtgccattctcctggccttcatcatcacatggaccccgtataacatcatggtcctggtttctaccttctgtgacaagtgtgtcccagtcaccctgtggcacttgggctattggttgtgctatgtcaatagcactgtcaaccccatctgctatgccctctgcaacagaaccttcaggaagacctttaagatgctgcttctctgccgatggaaaaagaaaaaagtggaagagaagttgtactggcaggggaacagcaagctaccctgaaaagtcaacaactcctctcgaaagaacaatgaccacagtcaacatcctctgaggatgagcaagctgattctggtttgtatattttcaaaaagaagacatctcattttgagtccttgaagatttttgtaaaggctcaagtttggttgccaaatggaaggggccatagctgcagcaattgctgacatattaaatgactcttgcctatgaccaaggccatttgatgccaggggagtttgccaatgaagtaaagggataggctcatggcccttcacaagaggaagcacactgggtaacaatgaacagtgactcagggaacttatgccccttctgtaggaaacagcagagaccaggtggaaaccttttcctgtggaaacctgtcatagaattttgtgcaatatgtatgtgtctatgaag

SEQ ID NO: 1177 - DNA, 2210 bp; single-stranded, linear
  immediate source library: GENBANK
  immediate source clone: g177989
acatgggaattaggcaggtagacacagtaatcatgcaggggaagggagatttgggagaaaataatgtggtttaaaaggagaaacaacattatgtattttaaaccaatgtttatattatgtttgttaattttattctatttccttgcaggtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctcctagttttaaaatctctgccattgcactttatagtctgattacaaaacgtgcaattcaggagcccagcagtgacacacttatcacgcctaggctccagtttgcaaaaattgcaccttataaactgtcagtattaggagcaatgagacaatgaaagaaacatgttgggatcgtggatttaagaaactatacactgtttctcataatctcttgaagaagggcttctgattctacaattttatcagtctctgcacaagaggaataaccttgttccttttttgttacttttgttgttgttgttctcatgtgtccttaagagaaggaatgccacagttacaaggtaaacatggagacttaaacataaagaaataggcactatacaatggggacataaaaaaagaaaatgaaagaaggatgcagaaatttgtctccggagtgttaagcatattttattcttttgttacggtcctatttagaggattggaatgtaataaatgcttattttttgcctttctttttcccaccatgaagagaaagcaaacaaacaga

SEQ ID NO: 1178 - DNA, 2595 bp; single-stranded, linear
  immediate source library: GENBANK
  immediate source clone: g177991
tctagaccaccagcctggacaacataccaagaccctgtctctacaaataaatagataaataaatagacactttttttaagtgtcaaaagtgcttggcacttagtagaccatcagtgttaggtgctcatacataccccgattattgccttgtcccagtgtcttgtacaggggttggagagnaggtgttaagaaatgaccgaatgggtaaatggatgaacagaacacctccctccagagcccacatgctcgtgggcctctgggaccactctcctcctcctcttgcttccctgagctcccccagcatggcctctgtccaggccttgcgctgcctccaggcctttgctgtggctactgcccctggagcgccatntccacagctcctcctgtggctggctcctcatcacccagatgacctggtgggtgaggccacctagcaaggagtcatgcctgtcctgccttctgactcactctctcatcaccctgccttttttttcttttgtggctcacgtgtttgcatgtctccccccatgaggcagggggccatgtgtgtcttattcacttctgtagccacagcaccctgagcaatgcttgccacatagtaggtgctcaattaatgttgaatgaatgggcaaaatgcgggatggcgggacagagttctctcaaggcattctgccagagaatgtccctctgtcaccttgaatccagtgtacctccagatgactcccccattccctcctgtagttcatgcttttctctccccttcctccccagacacggcctacccacccctggcaaccaacatggccaacttcacacctgtcaatggcagctcgggcaatcagtccgtgcgcctggtcacgtcatcatcccacaatcgctatgagacggtggaaatggtcttcattgccacagtgacaggctccctgagcctggtgactgtcgtgggcaacatcctggtgatgctgtccatcaaggtcaacaggcagctgcagacagtcaacaactacttcctcttcagcctggcgtgtgctgatctcatcataggcgccttctccatgaacctctacaccgtgtacatcatcaagggctactggcccctgggcgccgtggtctgcgacctgtggctggccctggactacgtggtgagcaacgcctccgtcatgaaccttctcatcatcagctttgaccgctacttctgcgtcaccaagcctctcacctaccctgcccggcgcaccaccaagatggcaggcctcatgattgctgctgcctgggtactgtccttcgtgctctgggcgcctgccatcttgttctggcagtttgtggtgggtaagcggacggtgcccgacaaccactgcttcatccagttcctgtccaacccagcagtgacctttggcacagccattgctgccttctacctgcctgtggtcatcatgacggtgctgtacatccacatctccctggccagtcgcagccgagtccacaagcaccggcccgagggcccgaaggagaagaaagccaagacgctggccttcctcaagagcccactaatgaagcagagcgtcaagaagccccgcccgggaggccgcccgggaggactgcgcaatggcaagctggaggaggcccccccgccagcgctgccaccgccaccgcgccccgtggctgataaggacacttccaatgagtccagctcaggcagtgccacccagaacaccaaggaacgcccagccacagagctgtccaccacagaggccaccactcccgccatgcccgcccctcccctgcagccgcgggccctcaacccagcctccagatggtccaagatccagattgtgacgaagcagacaggcaatgagtgtgtgacagccattgagattgtgcctgccacgccggctggcatgcgccctgcggccaacgtggcccgcaagttcgccagcatcgctcgcaaccaggtgcgcaagaagcggcagatggcggcccgggagcgcaaagtgacacgaacgatctttgccattctgctagccttcatcctcacctggacgccctacaacgtcatggtcctggtgaacaccttctgccagagctgcatccctgacacggtgtggtccattggctactggctctgctacgtcaacagcaccatcaaccctgcctgctatgctctgtgcaacgccacctttaaaaagaccttccggcacctgctgctgtgccagtatcggaacatcggcactgccaggtaggcaggcaggagtgccctaggaggtgcggtgtgcgtgcgtgtgctgggggaccacacggctcacttgctgtggggaagagtgcaggcaccattctgcgttcacgtttgctgaggaggaagttcagaagaggctctgtggctgcattcagagaccagatctctgctcacccgtgaggaggctcaccccagggagtgtctgaactggggctgcctggcccacctctgtggccctgcttcagcgagctgcggggcactggcctgggtgggcacctgcccactgtgaccaaccatcagcagtgctggaagaatggagatctggatgggggccgaagcccagggccccctcaggaagaacaaag

SEQ ID NO: 1179 - DNA, 1687 bp; single-stranded, linear
  immediate source library: GENBANK
  immediate source clone: g178149
cccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtagcaccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgtatacttgttgccaggaaggtgacctcaaaaattaaaagtataattattcggccgggcatggtggctcacacctgtaattccagcactttgggaggccaaggcaggcggatcacgaggtcaggagttcaaaaccagcctgtccaatatagtg

SEQ ID NO: 1180 - DNA, 3604 bp; single-stranded, linear
  immediate source library: GENBANK
  immediate source clone: g178195
ggatcctggcctctctcggatctgcaggaagggtgggctgtgcgggtccagagtgggatgcccgttctggccggcggtgcctgctgagcccttcctgatgtgactttattagacaaacccccactcccgccaggggtagacacacgagtatctgctttaggaagatttctgcaacacggcagggtgcaattcaaactctgggttctcctttcctgagcttagaaaccaatttgttcggagataggagaaggctctgttggcagaagacctaagagacgggaggaggcgcctggcgtcagcgggtcgcttctcagccgtgaccacgagcggccagcaggtgtcagtgcgtcctcgctttgccctggcgctcggctcctggacccctccccacctcggtctaagggggcgcggtccagaccccgggtcttgcgtttcccgcagacagcatcgcggctgggaggacacgtagccgcttcttccctaagcggaggtctgaactccggcttgtaccacttccccgtgggtgctgtccattccgccccaggggttccatccgaagccgcgccttcctccctctccaggacccctttctccccagcctccaggagcactgcggaccgcgtcggctctggcccggagctgggctgctccagacgtaactcacaccggaggttacttccctcgatttgggcggggattcccttccatttttttcttcccttttctcccaagatccagcttcttggggcactcacgggtgcccgttgcgttctgctccgtcggccccgagctgcatggccaactcccagcaggggccgctcctcccctaccccccacccccgggctccctctttaagtctctagctcaaggtacccgcctctccaaagggctcgtcccgcctgagggcaacgctccccgaggtccaggctaggcgcgggcgctagactggcggaggggtggtgcgaggggcgggggagggtcggcttcccacgtggggctgacgccggctgctcagcaacgcttgcttgatcctggggctataaaacgagtccaccgtgagcgcagcggagcagcagcagctccagctcggtgcagaagcccagcagcgcgtgccgccgcccggccactccagcgccttcttccccgccttgcgctcctgccccaactcgcgctgtcgtcggaccccggcccatccagcagcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtccccgagctccgcacagtgcgccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcaccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccggccatgggccgctagcggtcctccagttcgggcccggcctcctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcaggccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgcgcggcgcgggccgggggcgacggggatcgggacgccggctgcagggccgggggaggagcgcgtcggggctgccaaggcgtcgcgctggcgcgggcgggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctctgcgggcgggcgtctgctgctcctacaagggaagct

SEQ ID NO: 1181 - DNA, 2072 bp; single-stranded, linear
  immediate source library: GENBANK
  immediate source clone: g178197
ctgcaggcgcggctggggcgaaacgtgcgagctgagcgggcgcaaggtcctccgcgcctcctttaagaaccggcccagcccggcccgcgcccccagagcgtacggcatccgcgtggcggagggcgcgactttctccggtcccgggcgggacggggacggcggcgggacaacttgggaaacttctctggggcggacggcagggaccccgggcaccgtggaggaggatgtaggagggcggctgctggtcctgggtgttcccgacctcctaggccccgctcgtccaggccatggggctccagcgccctcgcggcgccggaggggcgacgctcttgtctagccgagccgggcagcgctgtcgtccacggtgcgcactgggcgggcagcgctccctctgcccacctcccgccccgtcatggaccaccaggacccctactccgtgcaggccacagcggccatagcggcggccatcaccttcctcattctctttaccatcttcggcaacgctctggtcatcctggctgtgttgaccagccgctcgctgcgcgcccctcagaacctgttcctggtgtcgctggccgccgccgacatcctggtggccacgctcatcatccctttctcgctggccaacgagctgctgggctactggtacttccggcgcacgtggtgcgaggtgtacctggcgctcgacgtgctcttctgcacctcgtccatcgtgcacctgtgcgccatcagcctggaccgctactgggccgtgagccgcgcgctggagtacaactccaagcgcaccccgcgccgcatcaagtgcatcatcctcactgtgtggctcatcgccgccgtcatctcgctgccgcccctcatctacaagggcgaccagggcccccagccgcgcgggcgcccccagtgcaagctcaaccaggaggcctggtacatcctggcctccagcatcggatctttctttgctccttgcctcatcatgatccttgtctacctgcgcatctacctgatcgccaaacgcagcaaccgcagaggtcccagggccaagggggggcctgggcagggtgagtccaagcagccccgacccgaccatggtggggctttggcctcagccaaactgccagccctggcctctgtggcttctgccagagaggtcaacggacactcgaagtccactggggagaaggaggagggggagacccctgaagatactgggacccgggccttgccacccagttgggctgcccttcccaactcaggccagggccagaaggagggtgtttgtggggcatctccagaggatgaagctgaagaggaggaagaggaggaggaggaggaggaagagtgtgaaccccaggcagtgccagtgtctccggcctcagcttgcagccccccgctgcagcagccacagggctcccgggtgctggccaccctacgtggccaggtgctcctgggcaggggcgtgggtgctataggtgggcagtggtggcgtcgaagggcgcacgtgacccgggagaagcgcttcaccttcgtgctggctgtggtcattggcgtttttgtgctctgctggttccccttcttcttcagctacagcctgggcgccatctgcccgaagcactgcaaggtgccccatggcctcttccagttcttcttctggatcggctactgcaacagctcactgaaccctgttatctacaccatcttcaaccaggacttccgccgtgccttccggaggatcctgtgccgcccgtggacccagacggcctggtgagcccgcctgcgctgcccctgtgggttggtgcggtggcgccggggtcaccctgcttcttgccctgctgtgtgtggctgcctcccctgggctttctgctccctgcccagatcctgtaggcctcatcttaggaaccccttgggaggggtgggcaggggggctgctagcaagggtcccagtgaagcttccccttgccggcttagctgtgggggaccccttctccaccctctccctgagcacaggccgatggaggtggttcaaatcctctggaacatagccaagaccaggagaagagagagcactttcttcc

SEQ ID NO: 1182 - DNA, 1723 bp; single-stranded, linear
  immediate source library: GENBANK
  immediate source clone: g178199
tgctacccgcgcccgggcttctggggtgttccccaaccacggcccagccctgccacaccccccgcccccggcctccgcagctcggcatgggcgcgggggtgctcgtcctgggcgcctccgagcccggtaacctgtcgtcggccgcaccgctccccgacggcgcggccaccgcggcgcggctgctggtgcccgcgtcgccgcccgcctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccgctgggagtacggctccttcttctgcgagctgtggacctcagtggacgtgctgtgcgtgacggccagcatcgagaccctgtgtgtcattgccctggaccgctacctcgccatcacctcgcccttccgctaccagagcctgctgacgcgcgcgcgggcgcggggcctcgtgtgcaccgtgtgggccatctcggccctggtgtccttcctgcccatcctcatgcactggtggcgggcggagagcgacgaggcgcgccgctgctacaacgaccccaagtgctgcgacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctacgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagccgtgccgccccggcttcgcctcggaatccaaggtgtagggcccggcgcggggcgcggactccgggcacggcttcccaggggaacgaggagatctgtgtttacttaagaccgatagcaggtgaactcgaagcccacaatcctcgtctgaatcatccgaggcaaagagaaaagccacggaccgttgcacaaaaaggaaagtttgggaagggatgggagagtggcttgctgatgttccttgttg

SEQ ID NO: 1183 - DNA, 480 bp; single-stranded, linear
  immediate source library: GENBANK
  immediate source clone: g178251
tgcgtgcagacctcggaggaggagtgctcgtccacgctggcagtgtgggtgaagtggcccatccatcccagcgccccagagcttgcgggccacaagagacagtttggctctgtctgccaccagggatcccaggtgtgtgatgagccctcctccgaagaccctcatgagtggccagaagacatcaccaagtggccgatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggatcttgcactgc

SEQ ID NO: 1184 - DNA, 1270 bp; single-stranded, linear
  immediate source library: GENBANK
  immediate source clone: g178895
ttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccctgtgcaccttgggtctcatcatgggcaccttcactctctgctggttgcccttctttctggccaacgtgctgcgcgccctggggggcccctctctagtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgcccggccctcttcccctcgggcgttcctgcggcccggagcagcccagcgcagcccaggctttgccaacggctcgacgggtaggtaaccggggcagagggaccggcg

SEQ ID NO: 1185 - DNA, 1529 bp; single-stranded, linear
  immediate source library: GENBANK
  immediate source clone: g178984
ctgcctccctctttcttcctccgctctttctcttccctctcgtttagtttgcctggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgaacctttaaataaattgtttgagtgtttttgagccccagacaaataatgttttaaagttatcccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcccatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaaaaaaaaaggaattc

SEQ ID NO: 1186 - DNA, 1277 bp; single-stranded, linear
  immediate source library: GENBANK
  immediate source clone: g179078
agggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctggggcctcttctgctttctcgggaattttcatctaggattttaagggaaggggaaggatagggtgatgttccgaaggtgaggagcttgaaacccgtggcgctttctgcagttcacaatgataacctgcaaactgcagaaagcgccacgggtttcaagctcctcaccttcg

SEQ ID NO: 1187 - DNA, 1829 bp; single-stranded, linear
  immediate source library: GENBANK
  immediate source clone: g179121
ctgcagaggcctggaaaaccatggaaaaaatcctattcctcaaagtcgagccctacctcctacgcctcttaaatcaattgccacagtgaccaatttgtcagtcacctaaaggcagctatcctgaccacttaagggagaatacttataatctttatacctaagtaaagattgtgagaggaaagaaatggtttaaagaatatgaatgtgtcacacttctgaggttaatgataaatgaattggtcctgcttacctcaggaaaaactttcaagtctttctgaaaaactaatttaattcagtagtattttctaagatttaggttatgtttttaatcaatttggaaaccaagatttacttatagaaaaaaaggaaaaggacctgaataggtttattcacatagaatcccaatttcacttctctggatgataccattttctacaaaagcaattatgttctaaaatttaagtgtgctttcttaggctttatcagttcacagtgtttccttaagaaatatgatccagtattttttcctaagactaaagttgagttactacgtttatgactgagaaatgaatgtttgttagtttgtttgtttacaataagaattttttctttaccattttatttttattttccccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcag

SEQ ID NO: 1188 - DNA, 2328 bp; single-stranded, linear
  immediate source library: GENBANK
  immediate source clone: g179699
agggggagcccaggagaccagaacatgaactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggccggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaataagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtaggcgacagcctcatgggccactgtggcccgatgtccccttccttcccggccattctccctcttgttttcacttcacttttcgtgggatggtgttaccttagctaactaactctcctccatgttgcctgtctttcccagacttgtccctccttttccagcgggactcttctcatccttcctcatttgcaaggtgaacacttccttctagggagcaccctcccaccccccacccccccccacacaccatctttccatcccaggcttttgaaaaacaaacagaaacccgtgtatctgggatatttccatatggcaataggtgtgaacagggaactcagaatacagacaagtagaaagattctcgcttaaaaaaatgtatttattttatggcaagttggaaaatatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtgggtgcctgtaatcccagctacttgggaggctgaggtgggagaattgctcgaaccttggaggtggaggttgtggtgagccatgatcgcaccactgcactctagcctgggtgaccgagggaggctctgtctcaaaagcaaagcaaaaacaaaaacaaaaacacctaaaaaacctgcagttttgtttgtactttgtttttaaattatgctttctattttgagatcattgcaaactcaacacaattgtaagtaatgatacagagggatcttgtgtacccttcacccagcctcccccaatggcaacatcttgcaaaactacaatgtagtctcataaccaggatattgacattgatacagtgaagatacaggacattctcatcaccacagggatccccaggatgcccacttccctccacccccacaccccagccgtgtccctaacccctggcaaccaggaatccactctccatttctataatgttgtcatttcaagaatgttattcaatggaatcatatagtatgtaacctgttttgagcttaaaaaaaaaagtatacatgactttaatgaggaaaataaaaatgaatattgaaaaaaaaaactttagag

SEQ ID NO: 1189 - DNA, 3588 bp; single-stranded, linear
  immediate source library: GENBANK
  immediate source clone: g179879
gtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccagaataaatgattcccactgatccacccacttttgccaccccaggatgcaattttctggagagaagattagtggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagccgaggaatgaaccagccaacaaccaaggcgaggagagtgctgagatcatccctttgaatatcatagagcaagagtcatctgcttgaatgtgaagcaaacacagtatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatattcagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatctttt

SEQ ID NO: 1190 - DNA, 1495 bp; single-stranded, linear
  immediate source library: GENBANK
  immediate source clone: g179984
atggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgaccagcagcctggctctcccagccaggttctgactcttggcacagcatggagtccgcctcttggatagagaggaatgtaatggtggcctggggcttctgaggcttctgggcttgagtcttttccatgaacttctcccctggtagaaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgagga

SEQ ID NO: 1191 - DNA, 1942 bp; single-stranded, linear
  immediate source library: GENBANK
  immediate source clone: g180110
atttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 1192 - DNA, 2889 bp; single-stranded, linear
  immediate source library: GENBANK
  immediate source clone: g180463
ctgggtcttgtctgcaaaactgccattggaaggcctccgtcccagtccttctacagagtagccagtgggattcccagccatgggcgaggtgacagcagaggaggtggagaagttcctggactcgaatattggctttgccaaacagtactacaacctccactaccgggccaagctcatctccgacctccttggggccaaggaggctgccgtggacttcagcaactaccactccccgagcagcatggaggagagcgaaatcatctttgatctcctgcgggactttcaggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggaggatgagcatttctgtgactttgtggacatcctcacagagtacaagaccaagaacatcttggcttcccccataatgaatgggaaggatgtggtggccataatcatggctgtgaataaagtggatggatcccacttcaccaagagagatgaagagattcttctcaagtacctcaattttgcaaatctaatcatgaagtggtaccacctgagttacctgcacaactgtgaaactcgacgtggccagatactgctgtggtctgggagcaaagtctttgaagaacttacggacatcgaacgacagttccacaaagccctgtacacagtccgtgctttcctcaactgtgacagatactctgtgggtctcttagacatgaccaagcagaaggaattttttgatgtgtggccggttctgatgggtgaagttccaccttactctggtcccaggactccggatggaagagaaattaacttttacaaggtcattgactacatcctgcatggcaaagaggacatcaaagtcatcccgaatccacctcctgaccattgggctttagtaagcggtctccccacttatgttgcccagaatggcctgatttgcaacatcatgaacgcgccttcagaggacttttttgcatttcagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttgaaaaccagagaggtgtatgggaaggagccatgggagtgtgaggaagaggagctggctgagatcctgcaagcggagctgccagatgcagataaatacgaaattaataaatttcacttcagtgacttacccctaacagaactggagctggtaaaatgtggaatacagatgtattatgagctcaaagtggtggataaatttcacattccacaagaggccctggtgcggttcatgtactccctgagtaagggctaccgcaagatcacctaccacaactggcggcacggcttcaacgtggggcagaccatgttctccctgctggtgacgggaaagctgaagcgctacttcacggacctagaggccttggccatggtcactgctgctttctgccatgacattgaccacagaggcaccaataacctctaccagatgaaatcccagaacccactggccaagctccatgggtcctctatcttggaaagacaccacttggagtttggcaaaacactgctcagagacgagagcctgaatatctttcaaaacctcaatcgtcgacagcatgagcatgccatccacatgatggacattgcaatcattgccacagacctcgccctgtatttcaagaagaggacgatgttccaaaagatcgtggatcagtctaagacatatgagagtgaacaggagtggacacagtacatgatgctggagcagacacggaaggaaatcgttatggccatgatgatgaccgcctgtgatctctcagccatcaccaaaccctgggaggtgcagagccaggtagctctgctggtggctgctgaattctgggaacaaggtgacctggagcgcacggtgctgcaacagaatcccattcccatgatggacagaaacaaagcagatgaactccctaagcttcaagtcggcttcattgactttgtttgcaccttcgtctacaaggaattctcccgtttccacgaggagatcaccccaatgttggacgggatcaccaacaatcgcaaggagtggaaggcgcttgctgatgagtacgatgccaagatgaaggtgcaggaggagaagaagcagaaacagcagtcggccaagtcagcagccgcaggaaatcagccggggggaaaccagcccaggggtgcaactacatccaagtcctgctgcatccagtaacaccactggggatgtgctggctggacggcaccaccctttcctgggaagagatgactcaagccagtggaagaccacacaccttgagaagtagaagagtcataggatttgaaagctgttagagaatttagcttccaggactgttcaatcttttggcttccctgggccacattggaagaattgtcttgggtcacacataaaatacagtaacactaatgatagctgttgaactt

SEQ ID NO: 1193 - DNA, 609 bp; single-stranded, linear
  immediate source library: GENBANK
  immediate source clone: g180696
ggatccggttccaggcctcggccctaaatagtctccctgggctttcaagagaaccacatgagaaaggaggattcgggctctgagcagtttcaccacccaccccccagtctgcaaatcctgacccgagggtccacctgccccaaaggcggacgcaggacagtagaagggaacagagaacacataaacacagagagggccacagcggctcccacagtcaccgccaccttcctggcggggatgggtggggcgtctgagtttggttcccagcaaatccctctgagccgcccttgcgggctcgcctcaggagcaggggagcaagaggtgggaggaggaggtctaagtcccaggcccaattaagagatcaggtagtgtagggtttgggagcttttaaggtgaagaggcccgggctgatcccacaggccagtataaagcgccgtgaccctcaggtgatgcgccagggccggctgccgtcggggacagggctttccatagccatggcccagcagtggagcctccaaaggctcgcaggccgccatccgcaggacagctatgaggacagcacccagtccagcatcttcacctacaccaacagcaactccgtgagccagc

SEQ ID NO: 1194 - DNA, 1241 bp; single-stranded, linear
  immediate source library: GENBANK
  immediate source clone: g181040
gaattcgcggccgccgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgacccgtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtaggg

SEQ ID NO: 1195 - DNA, 756 bp; single-stranded, linear
  immediate source library: GENBANK
  immediate source clone: g181145
gctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagactatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggccacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatatgcttct

SEQ ID NO: 1196 - DNA, 673 bp; single-stranded, linear
  immediate source library: GENBANK
  immediate source clone: g181175
gggcaactcaccctcactcagaggtcttctggttctggaaacaactctagctcagccttctccaccatgagcctcagacttgataccaccccttcctgtaacagtgcgagaccacttcatgccttgcaggtgctgctgcttctgtcattgctgctgactgctctggcttcctccaccaaaggacaaactaagagaaacttggcgaaaggcaaagaggaaagtctagacagtgacttgtatgctgaactccgctgcatgtgtataaagacaacctctggaattcatcccaaaaacatccaaagtttggaagtgatcgggaaaggaacccattgcaaccaagtcgaagtgatagccacactgaaggatgggaggaaaatctgcctggacccagatgctcccagaatcaagaaaattgtacagaaaaaattggcaggtgatgaatctgctgattaatttgttctgtttctgccaaacttctttaactcccaggaagggtagaattttgaaaccttgattttctagagttctcatttattcaggatacctattcttactgtattaaaatttggatatgtgtttcattctgtctcaaaaatcacattttattctgagaaggttggttaaaagatggcagaaagaagatgaaaataaataagcctggtttcaaccctct

SEQ ID NO: 1197 - DNA, 1756 bp; single-stranded, linear
  immediate source library: GENBANK
  immediate source clone: g181431
ccggcagcctcacgcgcgcaccgcgcctccgccccgtccccgcgctccctcctgcccgcccgccccggcccggccccgccccgccccgcgccgccgcggcccgtccactgctccccgcgggccagagccggccgagctgctgcccgccggggctctgaagggccggcggggcggtagagccaggaccggccgaggagagtgcgcgcccggacggctgccggaggggcggccgcgcgtggatgcggcgggagctggaagcctcaagcagccggcgccgtctctgcccccggggccctatggcttgaagagcctggacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccatgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccacggtctccacagcactcctgacagccccgccaaaccagagaagaatgggcatgccaaagaccaccccaagattgccaagatctttgagatccagaccatgcccaatggcaaaacccggacctccctcaagaccatgagccgtagaaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatccttcactgctgactctgctgcctgcccgcacagcagctgttcccacctccctgcccaggccagccagcctcacccttgcgaaccgtgagctaggaaggca

SEQ ID NO: 1198 - DNA, 452 bp; single-stranded, linear
  immediate source library: GENBANK
  immediate source clone: g181546
cctccagcgaccctagccatgagaaccctcaccatcctcactgctgttctcctcgtggccctccaggccaaggctgagccactccaagctgaggatgatccactgcaggcaaaagcttatgaggctgatgcccaggagcagcgtggggcaaatgaccaggactttgccgtctcctttgcagaggatgcaagctcaagtcttagagctttgggctcaacaagggctttcacttgccattgcagaaggtcctgttattcaacagaatattcctatgggacctgcactgtcatgggtattaaccacagattctgctgcctctgagggatgagaacagagagaaatatattcataatttactttatgacctagaaggaaactgtcgtgtgtcccatacattgccatcaactttgtttcctcatctcaaataaagtcctttcagcaaaaaaaaaaaa

SEQ ID NO: 1199 - DNA, 3984 bp; single-stranded, linear
  immediate source library: GENBANK
  immediate source clone: g181907
gtcctttcacgcgtgtcttcgtgttggtgcgcttttcactggtcataaagtgctgctcacggccgtgaactgctacagcgtgaaggccgccacccgggtccaggatgcttttgccgccgccaagctcctggccctggccctgatcatcctgctgggcttcgtccagatcgggaagggtgatgtgtccaatctagatcccaagttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgctttggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtcctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccagacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgttccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccaaggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccacctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccaggtccaggagaagtgctccctggaggcacggaccactgcttcccactggggccggcggggcccacgcacgacgtcagcctcttaccttcccgcctcggctaggggtcctcgggatgccgttctgttccaacctcctgttctgggaggtggacatgcctcaaggatacagggagccggcggcctctcgacggcacgcacttcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctag

SEQ ID NO: 1200 - DNA, 1840 bp; single-stranded, linear
  immediate source library: GENBANK
  immediate source clone: g181946
tccacacacacaaaaaacctgcgcgtgaggggggaggaaaagcagggcctttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaacaaaaaaaaaaacaaaaaaaaacaaaagtaaattaaaaacaaacctgatgaaacagatgaaacagatgaaggaagatgtggaaatcttagcctgccttagccagggctcagagatgaagcagtgaagagacagattgggagggaaagggagaatggtgtaccctttatttcttctgaaatcacactgatgacatcagttgtttaaacggggtattgtcctttccccccttgaggttcccttgtgagcttgaatcaaccaatctgatctgcagtagtgtggactagaacaacccaaatagcatctagaaagccatgagtttgaaagggcccatcacaggcactttcctagcctaat

SEQ ID NO: 1201 - DNA, 2757 bp; single-stranded, linear
  immediate source library: GENBANK
  immediate source clone: g181948
tctaaaggtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaatgtggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatatattctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatccgtctttcccacttttgttgatgtttatttcagaatcttgtgtgattcatttcaagcaacaacatgttgtattttgttgtgttaaaagtacttttcttgatttttgaatgtatttgtttcaggaagaagtcattttatggatttttctaacccgtgttaacttttctagaatccaccctcttgtgcccttaagcattactttaactggtagggaacgccagaacttttaagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaag

SEQ ID NO: 1202 - DNA, 1416 bp; single-stranded, linear
  immediate source library: GENBANK
  immediate source clone: g182066
cgttgaagacattgtcgggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacatacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttca

SEQ ID NO: 1203 - DNA, 1470 bp; single-stranded, linear
  immediate source library: GENBANK
  immediate source clone: g182275
gaaactgcggacgggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatg

SEQ ID NO: 1204 - DNA, 769 bp; single-stranded, linear
  immediate source library: GENBANK
  immediate source clone: g182482
ggccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagtttcgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagc

SEQ ID NO: 1205 - DNA, 1866 bp; single-stranded, linear
  immediate source library: GENBANK
  immediate source clone: g182662
cccagagcaagaccacagctggtgaacagtccaggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcctctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggcgttacaggcaaagtgaggagggagctgggggacactttcgagctcccagctccagcttcgtctcaccttgagttaggctgagcacaggcatttcctgcttattttaggattacccactcatcagaaaaaaaaaaaaagcctttgtgtcccctgatttggggagaataaacagatatgagtttattattgacttcttttttgattttggacctcagcctcgggtggtcagggtgggaaatgataggaagaagctgtcatctgcatcctagtttgcctgaaatgaacccaaataatacccattattattagtcctgaattatgagtagtgaatgatacccatcattctggcatcatgatgagtagtgtccacttccattctgaaaagtgccctgctgtgaaaaataaattatatagtcatcctaggtaaatgaaggaggagggagaagtgtgaaagagtatggcttaaatcagacaagatatacaagaagatactttatatagggcaggagcggtggctcatgcctgtaatcccagcactttgggaggccgaggcaggcggatcaccagaggtcaggaattcgagaacagcctggccaacatggtgaaaccctgtctctactaaaaatacaaaaattagctgggcgtagtggcaggctcccgtaatcccagctactcaggagaccgaggcaggagaatcgcttggacctggaaggcggaggttgtagtgagccaagaaaacgccactacactccagcctgggtgacagagagagactccggctcag

SEQ ID NO: 1206 - DNA, 1058 bp; single-stranded, linear
  immediate source library: GENBANK
  immediate source clone: g182666
atggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattgtgcttcacctcctgcagagactgagttacaggcaatgtgagg

SEQ ID NO: 1207 - DNA, 1062 bp; single-stranded, linear
  immediate source library: GENBANK
  immediate source clone: g182668
atggaaaccaacttctccattcctctgaatgaaactgaggaggtgctccctgagcctgctggccacaccgttctgtggatcttctcattgctagtccacggagtcacctttgtcttcggggtcctgggcaatgggcttgtgatctgggtggctggattccggatgacacgcacagtcaacaccatctgttacctgaacctggccctagctgacttctctttcagtgccatcctaccattccgaatggtctcagtcgccatgagagaaaaatggccttttgcgtcattcctatgtaagttagttcatgttatgatagacatcaacctgtttgtcagtgtctacctgatcaccatcattgctctggaccgctgtatttgtgtcctgcatccagcctgggcccagaaccatcgcaccatgagtctggccaagagggtgatgacgggactctggattttcaccatagtccttaccttaccaaatttcatcttctggactacaataagtactacgaatggggacacatactgtattttcaactttgcattctggggtgacactgctgtagagaggttgaacgtgttcattaccatggccaaggtctttctgatcctccacttcattattggcttcacggtgcctatgtccatcatcacagtctgctatgggatcatcgctgccaaaattcacagaaaccacatgattaaatccagccgtcccttacgtgtcttcgctgctgtggtggcttctttcttcatctgttggttcccttatgaactaattggcattctaatggcagtctggctcaaagagatgttgttaaatggcaaatacaaaatcattcttgtcctgattaacccaacaagctccttggccttttttaacagctgcctcaacccaattctctacgtctttatgggtcgtaacttccaagaaagactgattcgctctttgcccactagtttggagagggccctgactgaggtccctgactcagcccagaccagcaacacacacaccacttctgcttcacctcctgaggagacggagttacaagcaatgtga

SEQ ID NO: 1208 - DNA, 4079 bp; single-stranded, linear
  immediate source library: GENBANK
  immediate source clone: g182709
cgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccacgcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggcccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggacctgaaggggccatgatggcaacagatctggaacctcagcctggccagacacaggccctccctgttccccagagaaaggggagcccactgtcctgggcctgcagaatttcccttctgcctgccagctgcactgatgctgcccctcatctctctgcccaacccttccctcaccttggcaccagacacccaggacttatttaaa

SEQ ID NO: 1209 - DNA, 2393 bp; single-stranded, linear
  immediate source library: GENBANK
  immediate source clone: g182770
cgctgagatctgtggaggtttttctctgcaaatgcagaaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcacccctgaggccttccagaaccttcccaaccttcaatatctgttaatatccaacacaggtattaagcaccttccagatgttcacaagattcattctctccaaaaggttttacttgacattcaagataacataaacatccacacaattgaaagaaattctttcgtggggctgagctttgaaagtgtgattctatggctgaataagaatgggattcaagaaatacacaactgtgcattcaatggaacccaactagatgcagtgaatctaagcgataataataatttagaagaattgcctaatgatgttttccacggagcctctggaccagtcattctagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtccttgcctttgaagggtatgtcacaaggagctgacagtgcttctacacatttcatctaatttaatattcctggcatacctttaaggtaaattggtcaggaactattaattccatgtgatacattaggaagctgaattattagtaacaacaataataattaaagaatgcaatactgtaaaaaagcggccgcgaatt

SEQ ID NO: 1210 - DNA, 1191 bp; single-stranded, linear
  immediate source library: GENBANK
  immediate source clone: g183063
atgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaacgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtccccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccc

SEQ ID NO: 1211 - DNA, 1617 bp; single-stranded, linear
  immediate source library: GENBANK
  immediate source clone: g183172
agcagccaaggcttactgaggctggtggagggagccactgctgggctcaccatggaccgccggatgtggggggcccacgtcttctgcgtgttgagcccgttaccgaccgtattgggccacatgcacccagaatgtgacttcatcacccagctgagagaggatgagagtgcctgtctacaagcagcagaggagatgcccaacaccaccctgggctgccctgcgacctgggatgggctgctgtgctggccaacggcaggctctggcgagtgggtcaccctcccctgcccggatttcttctctcacttcagctcagagtcaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggacgtgtgttcctgaaggatgctgcccttttccacagcgacgacactgaccactgcagcttctccactgttctatgcaaggtctctgtggccgcctcccatttcgccaccatgaccaacttcagctggctgttggcagaagccgtctacctgaactgcctcctggcctccacctcccccagctcaaggagagccttctggtggctggttctcgctggctgggggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacctgtaaatgaaaaaaaaaaaa

SEQ ID NO: 1212 - DNA, 1062 bp; single-stranded, linear
  immediate source library: GENBANK
  immediate source clone: g183269
gctctgttctacagcacactaccagaagacagcagaaatgaaaagcatttactttgtggctgggttatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttc

SEQ ID NO: 1213 - DNA, 1541 bp; single-stranded, linear
  immediate source library: GENBANK
  immediate source clone: g183421
gttgtgctgtcagtgcaccagagacacaaggcttgaagctctgtcctgggaaaatatggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattacagtccaatggtatgctggagagttactctgcaaagttctcagttatctaaagcttttctccatgtatgccccagccttcatgatggtggtgatcagcctggaccgctccctggctatcacgaggcccctagctttgaaaagcaacagcaaagtcggacagtccatggttggcctggcctggatcctcagtagtgtctttgcaggaccacagttatacatcttcaggatgattcatctagcagacagctctggacagacaaaagttttctctcaatgtgtaacacactgcagtttttcacaatggtggcatcaagcattttataactttttcaccttcagctgcctcttcatcatccctcttttcatcatgctgatctgcaatgcaaaaatcatcttcaccctgacacgggtccttcatcaggacccccacgaactacaactgaatcagtccaagaacaatataccaagagcacggctgaagactctaaaaatgacggttgcatttgccacttcatttactgtctgctggactccctactatgtcctaggaatttggtattggtttgatcctgaaatgttaaacaggttgtcagacccagtaaatcacttcttctttctctttgcctttttaaacccatgctttgatccacttatctatggatatttttctctgtgattgatagactacacaagaagtcatatgaagaagggtaaggtaatgaatctctccatctgggaatgattaacacaaatgttggagcatgtttacatacaaacaaagtaggatttacacttaagttatcattcttttagaaactcagtcttcagagcctcaattattaaggaaaagctcttcaggaaaaatactaaaatatttctcttcctcataagcttctaaattaatctctgccttttctgacctcatataacacattatgtaggtttcttatcactttctctttgcataataatgtactaatatttaaaataccttcagcctaaggcacaaggatgccaaaaaaacaaaggtgagaaaccacaacacaggtctaaactcagcatgctttggtgagtttttctccaaaaggggcatattagcaattagagttgtatgctatataatacatagagcacagagccctttgcccataatatcaactttccctcctatagtt

SEQ ID NO: 1214 - DNA, 2154 bp; single-stranded, linear
  immediate source library: GENBANK
  immediate source clone: g183484
ggaattccgtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcagcgccatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatatcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcaggggaaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggccacgagcttgttctttgttctttgtcacagggactgaaaacctctcctcatgttctgctttcgattcgttaagagagcaacattttacccacacacagataaagttttcccttgaggaaacaacagctttaaaaaaaaaaaaggaattc

SEQ ID NO: 1215 - DNA, 1726 bp; single-stranded, linear
  immediate source library: GENBANK
  immediate source clone: g183649
ccagattctaaatatcaggaaagacgctgtgggaaaatagcaggccaaaagttcttagtaaactgcagccagggagactcagactagaatggaggtagaaagaactgatgcagagtgggtttaattctaagcctttttgtggctaagttttgttgttgttaacttattgaatttagagttgtattgcactggtcatgtgaaagccagagcagcaccagtgtcaaaatagtgacagagagttttgaataccatagttagtatatatgtactcagagtatttttattaaagaaggcaaagagcccggcatagatcttatcttcatcttcactcggttgcaaaatcaatagttaagaaatagcatctaagggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctcccatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcatcccactgtcgatcatctctgtttactactacttcattgctaaaaatctgatccagagtgcttacaatcttcccgtggaagggaatatacatgtcaagaagcagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctttatggctagacaggaacccttgcatccattgttgtgtctgtgccctccaaagagccttcagaatgctcctgagtggtgtaggtgggggtggggaggcccaaatgatggatcaccattatattttgaaagaagc

SEQ ID NO: 1216 - DNA, 562 bp; single-stranded, linear
  immediate source library: GENBANK
  immediate source clone: g183974
ggtaccggctccaccattttgctagagaaggccgcggaggctcacagaggtgcgcacacttgccctgagtcacacagcgaatgccctccgcggtcccaacgcagagagaacgagccgatcggcagcctgagcgaggcagtggttagggggggccccggccccggccactcccctcaccccctccccgcagagcgccgcccaggacaggctgggccccaggccccgccccgaggtcctgcccacacacccctgacacaccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaaggtgagtcgcg

SEQ ID NO: 1217 - DNA, 1191 bp; single-stranded, linear
  immediate source library: GENBANK
  immediate source clone: g184087
atggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggtaaaagctccaggtgtggagtgggacagaagtcacggccccccagggagccacagacaggtaagcgctgaacagagacttccgcaccgggtaccaacagctcttctgctgcagg

SEQ ID NO: 1218 - DNA, 1601 bp; single-stranded, linear
  immediate source library: GENBANK
  immediate source clone: g186270
aaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaaataaaaataaaaataaatttggttctaatagaactcagttttaactagaatttattcaattcctctgggaatgttacattgtttgtctgtcttcatagcagattttaattttgaataaataaatgtatcttattcacatc

SEQ ID NO: 1219 - DNA, 4079 bp; single-stranded, linear
  immediate source library: GENBANK
  immediate source clone: g186289
tagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctcgacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctgga

SEQ ID NO: 1220 - DNA, 1664 bp; single-stranded, linear
  immediate source library: GENBANK
  immediate source clone: g186342
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggctttcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagtgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatatttggtgtt

SEQ ID NO: 1221 - DNA, 534 bp; single-stranded, linear
  immediate source library: GENBANK
  immediate source clone: g186385
atggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagcggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtag

SEQ ID NO: 1222 - DNA, 4079 bp; single-stranded, linear
  immediate source library: GENBANK
  immediate source clone: g186496
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagact

SEQ ID NO: 1223 - DNA, 985 bp; single-stranded, linear
  immediate source library: GENBANK
  immediate source clone: g186512
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccact

SEQ ID NO: 1224 - DNA, 1051 bp; single-stranded, linear
  immediate source library: GENBANK
  immediate source clone: g187297
cgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttc

SEQ ID NO: 1225 - DNA, 1388 bp; single-stranded, linear
  immediate source library: GENBANK
  immediate source clone: g187388
ggatccagaagggtcattcaatcagttctcagtcttatcaggtctaagttcctttcttatcaggtcctaaaggcctaatcttatcattgtgacaaagataactgtagagtctgttaaactttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaaa

SEQ ID NO: 1226 - DNA, 775 bp; single-stranded, linear
  immediate source library: GENBANK
  immediate source clone: g188558
aaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagatgctcttttaaaaggt

SEQ ID NO: 1227 - DNA, 1455 bp; single-stranded, linear
  immediate source library: GENBANK
  immediate source clone: g188568
ggcggagttggaagcgcgttacccgggtccaaaatgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatcc

SEQ ID NO: 1228 - DNA, 1083 bp; single-stranded, linear
  immediate source library: GENBANK
  immediate source clone: g188673
atgagcatccaaaagaagtatctggagggagattttgtctttcctgtgagcagcagcagcttcctacggaccctgctggagccccagctcggatcagcccttctgacagcaatgaatgcttcgtgctgcctgccctctgttcagccaacactgcctaatggctcggagcacctccaagcccctttcttcagcaaccagagcagcagcgccttctgtgagcaggtcttcatcaagcccgagattttcctgtctctgggcatcgtcagtctgctggaaaacatcctggttatcctggccgtggtcaggaacggcaacctgcactccccgatgtacttctttctctgcagcctggcggtggccgacatgctggtaagtgtgtccaatgccctggagaccatcatgatcgccatcgtccacagcgactacctgaccttcgaggaccagtttatccagcacatggacaacatcttcgactccatgatctgcatctccctggtggcctccatctgcaacctcctggccatcgccgtcgacaggtacgtcaccatcttttacgcgctccgctaccacagcatcatgaccgtgaggaaggccctcaccttgatcgtggccatctgggtctgctgcggcgtctgtggcgtggtgttcatcgtctactcggagagcaaaatggtcattgtgtgcctcatcaccatgttcttcgccatgatgctcctcatgggcaccctctacgtgcacatgttcctctttgcgcggctgcacgtcaagcgcatagcagcactgccacctgccgacggggtggccccacagcaacactcatgcatgaagggggcagtcaccatcaccattctcctgggcgtgttcatcttctgctgggcccccttcttcctccacctggtcctcatcatcacctgccccaccaacccctactgcatctgctacactgcccacttcaacacctacctggtcctcatcatgtgcaactccgtcatcgacccactcatctacgctttccggagcctggaattgcgcaacacctttagggagattctctgtggctgcaacggcatgaacttgggatag

SEQ ID NO: 1229 - DNA, 2678 bp; single-stranded, linear
  immediate source library: GENBANK
  immediate source clone: g189043
cggccggccaatacataggaacacttgggtccctgcagtcagggtgtggaaatggcagatgagttcagccctaaggtgcatttttcttactaggaggagatggagtgtattttatgggatataagcattagctacatttcctgtcctgttcacatcctttgcccatgtgtctatgaggttattgatcttcttactgatttattgtagctctttacttaggaggttaattagccttttgcctgtggagagttttttggtttgccatttgtccttttttaattttttttgttttttggccatttgtcttttgactccgatgtggtttttgctgatttcctttgatgtattctagtttatctgacttttctttggcgacttatggactttctctcaccactaaaagccctcactgctctctcagtcttcttgatttaacctcctccaggcttccgccttctccaggccctgattctcagttggagttgctggtgcctcctccttcacccagcgtctgacgctggagtgctcacagtgtggctgggacccacttctctcctctgtagatacccacccctgtgttgatcacttgcaggcccgggttctgtgtgccatgtgtatgccctagagcccttgctcacgtttccccacagccttcatgaagtctgtgttcctcagatgccccacagacatcacaagcaaggcacatccaaaccccagaccactatccaggagcctgcaccctctttctgttggctccacctccagcctccgagacccacccacttccctgcatttgctgagaccatcattttccacctagacaatgcccccacgcttgccctacagcccttccaaaaacgattttttccaacttaaatcagactagaaagctttttcacatagcccagtcttcctccttgtgctgggttctgtctcattatcacctcatcagggaagtctgtacagatagaatccctacccctgcatttgtcgcctccgtctgcctctttggtcagtttcaggtccctgtagttcacactgtgtccccagggatgaagtgggtcccggcacggtgggcattctgtcatgaatgaatggtccccttgtgtatgcagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatcgcgttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcctcccctggttattgtgaggctggcgattacataagtataagcaggtcgcccagggcttggctactgtaggtgtccaataaacagtagatggaaacc

SEQ ID NO: 1230 - DNA, 1197 bp; single-stranded, linear
  immediate source library: GENBANK
  immediate source clone: g189134
atggggacctgtgacattgtgactgaagccaatatctcatctggccctgagagcaacaccacgggcatcacagccttctccatgcccagctggcagctggcactgtgggcaccagcctacctggccctggtgctggtggccgtgacgggtaatgccatcgtcatctggatcatcctggcccatcggaggatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaccacctcgtggtgatcgccctcatctacttcctgccgctcgcggtgatgtttgtagcctacagcgtcatcggcctcacgctctggaggcgcgcagtgcccggacatcaggcgcacggtgccaacctccgccatctgcaggccaagaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctgggttccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttga

SEQ ID NO: 1231 - DNA, 1605 bp; single-stranded, linear
  immediate source library: GENBANK
  immediate source clone: g189155
ccttctttaatgaagcaggagcgaaaaagacaaattccaaagaggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttaccag

SEQ ID NO: 1232 - DNA, 1987 bp; single-stranded, linear
  immediate source library: GENBANK
  immediate source clone: g189237
ctcgagagctccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattgtcggctccgacctgggacccctcatggtgactgaagcccttaagccatactcttcaggaggtccccgcgtctggtatgtctccaacattgatggaactcacattgccaaaaccctggcccagctgaacccggagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaacaaagatgccacggaggaggt

SEQ ID NO: 1233 - DNA, 1352 bp; single-stranded, linear
  immediate source library: GENBANK
  immediate source clone: g189241
gtgctgtgaggcttgcccgcggacagtaaacttgcaggggcgagagggagggacatcgattaaacctaaatcgtgggcgttcagtcctcagggcaccgagcgcgtgaaaactccagcggactctgctggaaaggagatcatgccctctaagtctctttccaacctctcggtgaccaccggcgcgaatgagagcggttccgttcccgaggggtgggaaagggatttcctgccggcctcggacgggaccaccacggagttggtgatccgctgtgtgatcccgtccctctacctgctcatcatcaccgtgggcttgctgggcaacatcatgctggtgaagatcttcatcaccaacagcgccatgaggagcgtccccaacatcttcatctctaacctggcggccggggacttgctgctgctgctcacctgcgtcccggtggacgcctcgcgctacttcttcgacgagtggatgtttggcaaggtgggctgcaaactgatccctgtcatccagctcacttccgtgggggtttccgtgttcactctcactgccctcagcgccgacaggtacagagccatcgttaaccccatggacatgcagacgtcaggggcattgctgcggacctgtgtgaaggccatgggtatctgggtggtctccgtgttgctggcagttcccgaagcggtgttttcagaagtggctcgcatcagtagcttggataatagcagcttcacagcatgtatcccataccctcaaacagatgaattacatccaaagattcattcagtgctcattttcttggtctatttcctcataccacttgctattattagcatttattattatcatattgcaaagaccttaattaaaagcgcacacaatcttcctggagaatacaatgaacataccaaaaaacagatggaaacacggaaacgcctggctaaaattgtgcttgtctttgtgggctgtttcatcttctgttggtttccaaaccacatcctttacatgtatcggtctttcaactataatgagattgatccatctctaggccacatgattgtcaccttagttgcccgggttctcagttttggcaattcttgtgtcaacccatttgctctttacctactcagtgaaagcttcaggaggcatttcaacagccaactctgctgtgggaggaagtcctatcaagagagaggaaccagctacctactcagctcttcagcggtgcgtatgacatctctgaaaagcaatgctaagaacatggtgaccaattctgttttactaaatgggcacagcatgaagcaggaaatggcaatgtgattttggccattcaactcactacctggagagaacttagtaa

SEQ ID NO: 1234 - DNA, 3690 bp; single-stranded, linear
  immediate source library: GENBANK
  immediate source clone: g189259
cagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcattctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcc

SEQ ID NO: 1235 - DNA, 1225 bp; single-stranded, linear
  immediate source library: GENBANK
  immediate source clone: g189313
cgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagactttttttttatacgataaataacttttttttaagttacacatttttcagatataaaagactgaccaatattgtacagtttttattgcttgttggatttttgtcttgtgtttctttagtttttgtg

SEQ ID NO: 1236 - DNA, 1842 bp; single-stranded, linear
  immediate source library: GENBANK
  immediate source clone: g189389
ccacagtggcgccggcagagcaggagtggctggaggagctgtggttggagcaggaggtggcacggcagggctggagggctccctatgagtggcggagacggcccaggaggcgctggagcaacagctcccacaccgcaccaagcggtggctgcaggagctcgcccatcgcccctgcgctgctcggaccgcggccacagccggactggcgggtacggcggcgacagacggattggccgagagtcccagtccgcagagtagccccggcctcgaggcggtggcgtcccggtcctctccgtccaggagccaggacaggtgtcgcgcggcggggctccagggaccgcgcctgaggccggctgcccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacgggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcagccgaagaaaagcaacgagctgccgcaggccaaccgactcccagggatctttgatgacgtccacggctcccacggccggcaggtctgccgtcggcacgagctctacgtcagcttccaggacctcggctggctggactgggtcatcgctccccaaggctactcggcctattactgtgagggggagtgctccttcccactggactcctgcatgaatgccaccaaccacgccatcctgcagtccctggtgcacctgatgaagccaaacgcagtccccaaggcgtgctgtgcacccaccaagctgagcgccacctctgtgctctactatgacagcagcaacaacgtcatcctgcgcaagcaccgcaacatggtggtcaaggcctgcggctgccactgagtcagcccgcccagccctactgcagccacccttctcatctggatcgggccctgcagaggcagaaaacccttaaatgctgtcacagctcaagcaggagtgtcaggggccctcactctctgtgcctacttcctgtcagg

SEQ ID NO: 1237 - DNA, 4079 bp; single-stranded, linear
  immediate source library: GENBANK
  immediate source clone: g189391
gcgagaaccccgactgaccgcggccacggcggctccccgacctgccgcgtcctgcgggcggcgctgggctccgggcactcgggctgcgcccccatggcctcgcccgcggggaacctgagcgcgtggccgggctgggggtggccgccgccggccgcgctgaggaacctgacctcctccccggccccgaccgcgtccccgtccccggccccgtcgtggacgccctcgccgcgccccggccccgcgcacccgttcctgcagccgccctgggccgtggcgctctggtcgctggcctacggcgccgtggtggccgtggcggtgctcggcaacctcgtggtgatctggatcgtgctggcccacaagcgcatgcggacggtcaccaactccttcctcgtgaacctggccttcgccgacgccgccatggccgcgctcaacgcgctggtcaacttcatctacgcgctgcacggagagtggtacttcggcgccaactactgccgcttccagaacttcttccccatcaccgccgtgttcgccagcatctactccatgacggccatcgcggtggacagatacatggccattattgaccccctgaagcccaggctgtctgccacggccacccggatcgtcattggaagcatctggattctggcatttctacttgcatttcctcagtgtctgtattccaaaatcaaagtcatgccaggccgtactctttgctacgtgcagtggccagaaggttcaaggcaacatttcacgtaccacatgatcgtcatcgtcctggtgtactgctttcctttgctcatcatgggcatcacctacaccatagttggaatcacgctctggggaggggagatcccaggagacacctgcgacaagtaccaggagcagctgaaggccaagcggaaggttgtaaaaatgatgatcatcgttgtggtgacctttgccatctgctggctgccctatcacatctacttcatcctcaccgccatctatcagcagctgaacaggtggaaatacatccagcaggtctacctggccagcttctggctggccatgagctcgaccatgtacaaccccatcatctactgctgtctgaataagagatttcgtgctggcttcaagagggccttccgctggtgccctttcatccacgtctccagctacgacgagctggagctcaaagccaccaggctccacccaatgcgacagagcagcctatacacagtgacaagaatggagtccatgagcgtggtattcgactccaacgatggggacagtgccaggtccagtcaccagaagagagggacgaccagagacgtaggctccaatgtctgctcccgcaggaactccaagtccacctccaccacagccagcttcgtgagctcctcccacatgtcggtggaagaaggctcttgatttctctctggggtcaaggccactgcaggcaccccttctcctgtcactgctgctgtctctcactctctggaagctgaaggacagtttttagacagctacgcttacaataagacagattgcacataaatataacaaaaatactactaagatatgagctctccccccaaaaaaagaacaaaatgggctttaagagtatgccttgaaaactctaaattattaatatgatacaaacaaaaatatagatccgagaaatatttataaagtgtccagttttgcttatttaaaagtcactgtgcacatttgtgacactgatatggtagttttttcccaaaatattaaagtttaaaatttaatactgtcagtgaagagaagccatgttttccattacagagcatagaatggaaaagttaaatgactcattttcttacaatagtgatggaaatttaacctcaaaaactaacaattaacgaaatctcaagaaaacctattttgtaccataacaattttcaaagacatttaaatgaaaaggaaacctaaatcaaaccactaggcttatctaaatgcctttctcttatttttttctgagaaaatgatttcaaaggaaaaaaatgtagctttgattgttacatattttaaatgccaagttaatatgtagttaaacttaagaccttaaaaggacaaacaaaattcctatgatcctctatttttcagaattttgttctaagtaggtaagttgtaagacattaaatatactttctgagatggaaggaaagaatcccatttgtctctgtaactggctgctagcctttaggcaggaaccacccacagcctcacgtagccatgaaggtggacaggaacacctcccagctccaaggcagttgtttttcccctgtaccccagcaaaagttccagacatgcactttatcaaccatatcgtgtcctcctcctccttcatcaaagaaggagtgtgggcatgggggaaggatcagaatgcgtcttgtgaaaatcctgagaggaaaaagttgtaagaattatgaaagcaaatatagctgatgaagttaatatacatgttggaaaatcagacaggaagtagaaagttgagtcaactctttgaaagatgtaccatagtttgggtcacccgtcaggtgagtgacaatattaccctgctgttccacacagagacctgtacgctctgcataggtaacccttgtccctccagaaaggacgggaaagaggcatttgttttactacaatagtatattttttgagaaccatatttgtgagtgttttatgcctcaatcttgaagcatgaacctttccttaaattaggaatactgtcaatcctgctgaagaaatcacaacccttctggaaatctaaatgtgttatataaacttctgtaaaatattgttaggttttgaaaactgtctaaaataattatctctaacatttatttcattgctatgccttccttagtgtcagaaccaaataacttttcaaagatcagcataaaagcaattatccaatgacaagtgatggtctattgttaccctgatattaatctcccaatcctgctttggagccaaagtcagaaatatttagttgttagtctaaacagcttaacaacatgagtttgagttgaatttcttttaatgacaccaataaacacaaacaagtagatggcacaataaatttgcagacatatacaaccagccaatgaatgtaacaatatcaagaagtaaattaaaattaattctaaaacagtataagtggtctttccagggttcctagaaataacctaataaaatctgtgaaacatgtgtgcacttttttagataaacaaatgtatcataatttagaatctaattgtttgaatgttttaacatgtacgggagcttggtcttcaaatttcatatagtcagccactaacaaagtatatctgaaatacatactcttgaccttcacatgcattacgcaaattcatgctatggcgtttctaaagaaaaaatagtagcttaatcttgttttgttctgtttgtttggaattttttctttagtagatttgttgttgccttgcttaccgagcatcactccttctagtatggcagaaatactgaggtccaggtcacatctcttaaatagttaagaaaaactgacatcatttactcaatagtcatgacttttaaactaagatttattatatataattttcaagttcaagaaatgtaagcaataacagtaaaatgaatgaaaaaggctaaaggttagcccttgtgtctgaatttcgaagctaaaaagtatgaaatgatgcccatgcagagccgctttagtgggctctctgtgagtaaatctatgccagtgttttcacatttgccaaggcttagaagcatttgcctccaaatgcgctctaccccaatactaacgtccacgtccatcttcttcattatttgcagtcaaacactactcaggacactgagcagataggtacaacatcttagggtttattaaatttagatcagcagacaaaaatcctaaactatgttgagaaaaatatgggaaaaaaaagccttgccttgttttaaatattctcctttttgaaagaacatgctagtaaaacaaacaaacattgaatttctattattttgcacctggacaaagtgactga

SEQ ID NO: 1238 - DNA, 493 bp; single-stranded, linear
  immediate source library: GENBANK
  immediate source clone: g189410
cccagcgcacccgcaccatggccggccccagcctcgcttgctgtctgctcggcctcctggcgctgacctccgcctgctacatccagaactgccccctgggaggcaagagggccgcgccggacctcgacgtgcgcaagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccggacggctgccacgccgaccctgcctgcgacgcggaagccaccttctcccagcgctgaaacttgatggctccgaacaccctcgaagcgcgccactcgcttcccccatagccaccccagaaatggtgaaaataaaataaagcaggtttttctcctct

SEQ ID NO: 1239 - DNA, 1551 bp; single-stranded, linear
  immediate source library: GENBANK
  immediate source clone: g189537
ctggtggcctttaatacctggctgttgctgaaaggtctttagaaacggcgctaacagcaggtttgtggaatgccggatcgctcaacggcctgacgtgggcaaaaacctcgccttccgcacccatcattatattgatgctcattgccgccgccttactggtacgccggatgcgcttgctggaaatgggacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtggggcatactacagtaactgtgacttgatgactttatctgagtccttat

SEQ ID NO: 1240 - DNA, 1162 bp; single-stranded, linear
  immediate source library: GENBANK
  immediate source clone: g189675
acgcgtctcccccacggtgcgaagtgggtacggctcgcaggggcggggccaggtcatgtgacgcggccgcgccgcattttgttctgcggtgctggtatttagagcgcacgctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcagcgccgcccgcccccagtagttggtcttgtacatgcgcagtatcctagtgcccatcgtctgtttccccgccttgcccccgcccgccccgtgccgtggacatctgggcccactcatcgcccctccaggcccccggcgccccaccccctaaagtgctctagtatgcggatgatttagaattgtcatttctctttactggatgtttattattaaagatctcgcctgttcctgcgtctgcggagccgcccttgtctcccagctatctataaccttagcttgtgtgtcgccttgtgggttcctgttgctgagacttttcctggatggagccgccctcaccgcgcccgtggccctgcgcggagctgtgtccaataaagttcttgct

SEQ ID NO: 1241 - DNA, 1668 bp; single-stranded, linear
  immediate source library: GENBANK
  immediate source clone: g189846
atggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccattcggaagtggttggcggccatcacacctccattaacgacctgctgttcgggatccaggccgggcccgagcagtactcagcctgggtaaactcgctgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggggcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtga

SEQ ID NO: 1242 - DNA, 439 bp; single-stranded, linear
  immediate source library: GENBANK
  immediate source clone: g189850
ccgcagcatgagctccgcagccgggttctgcgcctcacgccccgggctgctgttcctggggttgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtgtgtgcatttgctatatagcatacttcttttttccagtttcaatctaactgtgaaagaaacttctgatatttgtgttatccttatgattttaaataaacaaaataaatc

SEQ ID NO: 1243 - DNA, 1579 bp; single-stranded, linear
  immediate source library: GENBANK
  immediate source clone: g189927
tgctcctcggagatacccttcgccgaagcagtaagaacttcctgcttgggtctctgcattcccttcctccgaaacttcccaggagaagggcggaagaccccaggggaaggggcgaggcgaatcttcgcgctgctttttcttccctcccccttcccgcgccgggcgcgcaggcatggatgtgctcagccctggtcagggcaacaacaccacatcaccaccggctccctttgagaccggcggcaacactactggtatctccgacgtgaccgtcagctaccaagtgatcacctctctgctgctgggcacgctcatcttctgcgcggtgctgggcaatgcgtgcgtggtggctgccatcgccttggagcgctccctgcagaacgtggccaattatcttattggctctttggcggtcaccgacctcatggtgtcggtgttggtgctgcccatggccgcgctgtatcaggtgctcaacaagtggacactgggccaggtaacctgcgacctgttcatcgccctcgacgtgctgtgctgcacctcatccatcttgcacctgtgcgccatcgcgctggacaggtactgggccatcacggaccccatcgactacgtgaacaagaggacgccccggccgcgtgcgctcatctcgctcacttggcttattggcttcctcatctctatcccgcccatcctgggctggcgcaccccggaagaccgctcggaccccgacgcatgcaccattagcaaggatcatggctacactatctattccacctttggagctttctacatcccgctgctgctcatgctggttctctatgggcgcatattccgagctgcgcgcttccgcatccgcaagacggtcaaaaaggtggagaagaccggagcggacacccgccatggagcatctcccgccccgcagcccaagaagagtgtgaatggagagtcggggagcaggaactggaggctgggcgtggagagcaaggctgggggtgctctgtgcgccaatggcgcggtgaggcaaggtgacgatggcgccgccctggaggtgatcgaggtgcaccgagtgggcaactccaaagagcacttgcctctgcccagcgaggctggtcctaccccttgtgcccccgcctctttcgagaggaaaaatgagcgcaacgccgaggcgaagcgcaagatggccctggcccgagagaggaagacagtgaagacgctgggcatcatcatgggcaccttcatcctctgctggctgcccttcttcatcgtggctcttgttctgcccttctgcgagagcagctgccacatgcccaccctgttgggcgccataatcaattggctgggctactccaactctctgcttaaccccgtcatttacgcatacttcaacaaggactttcaaaacgcgtttaagaagatcattaagtgtaacttctgccgccagtgatgacggaggagtagccggccagtcgaggctacaggatccgtcccattcactatgcttcccccaaccctagggaatccacacttaatataattcgccacttctcctctttttctctgctccgctcacggcttgcagacctgg

SEQ ID NO: 1244 - DNA, 3014 bp; single-stranded, linear
  immediate source library: GENBANK
  immediate source clone: g189934
ctgaccagcgccgccctcccccgcccccgacccaggaggtggagatccctccggtccagccacattcaacacccactttctcctccctctgcccctatattcccgaaaccccctcctccttcccttttccctcctccctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtgg

SEQ ID NO: 1245 - DNA, 2875 bp; single-stranded, linear
  immediate source library: GENBANK
  immediate source clone: g190003
gaattctccggagctgaaaaaggatcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgacatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacaaggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagttaggtgacaaatgatgttgattatgtaaggatatacttagctacattttcagtcagtatgaacttcctgatacaaatgtagggatatatactgtatttttaaacatttctcaccaactttcttatgtgtgttctttttaaaaattttttttcttttaaaatatttaacagttcaatctcaataagacctcgcattatgtatgaatgttattcactgactagatttattcataccatgagacaacactatttttatttatatatgcatatatatacatacatgaaataaatacatcaatataaaaataaaaaaaaacggaattc

SEQ ID NO: 1246 - DNA, 4079 bp; single-stranded, linear
  immediate source library: GENBANK
  immediate source clone: g190035
gaattcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgatgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgctgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctgaggttcaggaggatgtatgccctcatccagcactaccgcgagacgcacctgccgtgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatacggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaaggagcagggcgatcctccggtggagtttgccacagacagggtggaggagctctttgagtggtttcagagcatccgagagatcacgtggaagattgacagcaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatggcaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccactccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaagga

SEQ ID NO: 1247 - DNA, 4079 bp; single-stranded, linear
  immediate source library: GENBANK
  immediate source clone: g190037
ggggtgccgccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcatcaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcag

SEQ ID NO: 1248 - DNA, 4079 bp; single-stranded, linear
  immediate source library: GENBANK
  immediate source clone: g190039
cagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacc

SEQ ID NO: 1249 - DNA, 2309 bp; single-stranded, linear
  immediate source library: GENBANK
  immediate source clone: g190337
tttgtcttcaagagtttttcgagaccagggaagaaggaaggaaatgcccagtttgatcgtgggagtggtaaaatgataaagtagatctgggtggggtttgtagcaccagagcataatggagaaacaccttggttttgtaatcaagactggatctaccagtgacttgctgaataacttcggtgattcctttctcttcttgggtctcactgtatttcaaaacatgaagaatttcattgtaatgttacctaataagtgagccagcacttctactctgtgagaaagtaggaaaactcttgggacaatcagagatgatgtgatgtaatgtccattagttcttcctgtgaataatcctgagggaaagcccccaggtccctcccagaatggggtggatatttcccaatacagctaaggaattatcccttgtaaataccacagacccgccctggagccaggccaagctggactgcataaagattggtatggccttagctcttagccaaacaccttcctgacaccatgagggccagcagcttcttgatcgtggtggtgttcctcatcgctgggacgctggttctagaggcagctgtcacgggaggtgagtgaacaggtgacctgctgggctgggttggactaaggggagaccctctggacaccctgggccaggacagggagcactactgaagcagtaggcagcactggagcccagatttcagctttctgttctttgccatcatattcagaaaaaataggactttggctggtggactccacgtgctttccacctcagtgactgagatatcaggactgtttgtggaagtaatgttggtatgtggccttggcctcagatgtcaatacctgtgcagaatgtgcaataaaataatgaactccaggattttaaaccttgggtgtggacacagtccccgtttctctgccccataaaagcactggagtaatcagtactctaaaaggaggttaagaaacaacaagccttcaggaatcatgttgtttgaggacccccattttataaggagggaaccaaaaatgtagaaatgagtgagcaattgccaaggtaattcccagagccaggatggggctcaagtctcctagtatgtggctcagggttctttcctactccaatgcacttcctaacaaatgacaatgtgtcctcttcactgctgggtgtcaccccagtctgaccactgctcctgagagacttggagtggaggaagggggaagaaacaaatactcaagggaactctggtcctgtagaccaccccaaaaaaggaagagccttccaagagtgtagctcccagaggtgtaccttccctactcaggccatggtttgaggatgctgcagtaagcagtggatggacccagacccagaggaaagacatggcagctgaagcagaggcttactgggtataaatgtgggctcgtttcttcttttaacagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgaggtgagcactagctggagaacgaggagacccctgaagacacaaaagaaggctgagcggtggggaagcatcccaggttggtgggagggaggttgtgggaggtgacagaaagactgggagactgaggggtctgagaggctataaccagagtgcctagaaggatgatctgtcttcctcactgcctctgagtgctttgatgtgctgactctcacctctgatactcttctcttccacagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagacttccttctgctccacttgtttctggttcctatgacttctgggctcctggatgctttggggaaatggatgtagaattgggacttcttctctccagtgaagaggggaaacggtcccatggtgaaagagagcaggnnggaggaaacaaggaggcacatgctagggcttcatattacaatccaataatcag

SEQ ID NO: 1250 - DNA, 432 bp; single-stranded, linear
  immediate source library: GENBANK
  immediate source clone: g190687
ccatggaagtcggaatccgctaaggagtgtgtaacaactcacctgccgaatcaacaagagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaata

SEQ ID NO: 1251 - DNA, 1147 bp; single-stranded, linear
  immediate source library: GENBANK
  immediate source clone: g190695
ctttgcattgttcctcatccgcctccttgctcgccgcagccgcctccgccgcgcgcctcctccgccgccgcggactccggcagctttatcgccagagtccctgaactctcgctttctttttaatccccttcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgttggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctcctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgacatgttcattataatctcaaaggagaaaaaaaacctgtaaaaaaagcaaaaatgacaacagaaaaacaatcttattccgagcattccagtaactgttttgtgtatgtacttagctgtactataagtagttggtttgtatgagatggttaaaaaggccaaagataaaaggtttctttttttttccttttttgctatgaagttgctgtttattttttttggcctgttttgatgtatgtgtgaaacaatgttgtccaacaataaacagg

SEQ ID NO: 1252 - DNA, 1595 bp; single-stranded, linear
  immediate source library: GENBANK
  immediate source clone: g190717
ccggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtatttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttaaaaaaaa

SEQ ID NO: 1253 - DNA, 1948 bp; single-stranded, linear
  immediate source library: GENBANK
  immediate source clone: g190721
cggagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggcctggggccaagaggaaaaacagggaaaaaaagaaaaaaaaaagaaaaaggaa

SEQ ID NO: 1254 - DNA, 3615 bp; single-stranded, linear
  immediate source library: GENBANK
  immediate source clone: g190738
gaattcgggggagtaagagacacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaacaagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgcgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagcccgaattc

SEQ ID NO: 1255 - DNA, 651 bp; single-stranded, linear
  immediate source library: GENBANK
  immediate source clone: g190878
atggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtga

SEQ ID NO: 1256 - DNA, 1382 bp; single-stranded, linear
  immediate source library: GENBANK
  immediate source clone: g219405
ccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgccgaggggggcgcgggcggtgcggacgggcagggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggtgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactc

SEQ ID NO: 1257 - DNA, 4079 bp; single-stranded, linear
  immediate source library: GENBANK
  immediate source clone: g219649
tcgcggccgcctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgacacctccccgggagaagcagtgcccaggaagttttctgaagccggggaagctgtgcagccgaagccgccgccgcgccggagcccgggacaccggccaccctccgcgccacccaccctcgctttctccggcttcctctggcccaggcgccgcgcggacccggcagctgtctgcgcacgccgagctccacggtgaaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcacttaagccgtatattgaagaaaactgtgtataacgaaatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgactccgggaatctcttctctgatccttcttccttaattcactcccacacccaagaagaaatgctttccaaaaccgcaaggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgattttttgtccttcagccaaacacaatatgggctcaggtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactatttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatactgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcggaaattttcattcaggtatttgtaatagtgacatatatatgtatatacatatcacctcctattctcttaatttttgttaaaatgttaactggcagtaagtcttttttgatcattcccttttccatataggaaacataattttgaagtggccagatgagtttatcatgtcagtgaaaaataattacccacaaatgccaccagtaacttaacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagctaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaa

SEQ ID NO: 1258 - DNA, 2635 bp; single-stranded, linear
  immediate source library: GENBANK
  immediate source clone: g219678
cgatcgccacggtccttccgccctctccttcgtccgctccatgcccaagagctgcgctccggagctggggcgaggagagccatggaggaaccgggtgctcagtgcgctccaccgccgcccgcgggctccgagacctgggttcctcaagccaacttatcctctgctccctcccaaaactgcagcgccaaggactacatttaccaggactccatctccctaccctggaaagtactgctggttatgctattggcgctcatcaccttggccaccacgctctccaatgcctttgtgattgccacagtgtaccggacccggaaactgcacaccccggctaactacctgatcgcctctctggcggtcaccgacctgcttgtgtccatcctggtgatgcccatcagcaccatgtacactgtcaccggccgctggacactgggccaggtggtctgtgacttctggctgtcgtcggacatcacttgttgcactgcctccatcctgcacctctgtgtcatcgccctggaccgctactgggccatcacggacgccgtggagtactcagctaaaaggactcccaagagggcggcggtcatgatcgcgctggtgtgggtcttctccatctctatctcgctgccgcccttcttctggcgtcaggctaaggccgaagaggaggtgtcggaatgcgtggtgaacaccgaccacatcctctacacggtctactccacggtgggtgctttctacttccccaccctgctcctcatcgccctctatggccgcatctacgtagaagcccgctcccggattttgaaacagacgcccaacaggaccggcaagcgcttgacccgagcccagctgataaccgactcccccgggtccacgtcctcggtcacctctattaactcgcgggttcccgacgtgcccagcgaatccggatctcctgtgtatgtgaaccaagtcaaagtgcgagtctccgacgccctgctggaaaagaagaaactcatggccgctagggagcgcaaagccaccaagaccctagggatcattttgggagcctttattgtgtgttggctacccttcttcatcatctccctagtgatgcctatctgcaaagatgcctgctggttccacctagccatctttgacttcttcacatggctgggctatctcaactccctcatcaaccccataatctataccatgtccaatgaggactttaaacaagcattccataaactgatacgttttaagtgcacaagttgacttgccatttgcagtggggtcgcctaagcgacctttggggaccaagttgtgtctggttccacaggtaggtcgaatcttctttcgcggtttctgggtcccagcgaggctctctctcctgggcaagggcaatggatcctgagaagccagaatagtcctgagagagagctctgaaaggagaagtgttgaaactaaatgtagagcttccctgcccaggaggaggctcacttcctcccctcaagccccgggctcagcactgaccctgcggtagccaatcccaaagggggttgcaacttttaaaaattgataatggaagggaatccctgccctgctttggtatcgtggataatgcccactagaagcagtgtacttgtaattgttgtctgaagcctgtctgagacagatctacatacagcctggcagtacttgaactagacgcttaatgccctgtgtttttggggagaactttgtgttacagcttaatttaagaacagttactttggcatcattcagtcttcactttttgtctatttaaacttggttggagaaacttgtggatttggtgcttcaaaccctatgtgtggcttggatggcgcagagaaaccttgaagagttaacagcaaaattctgatgctgagatctctatttttattatacttgaaactatatgggggtgggtgggtgggaatgggagatgaggagtgttaaactgagaatcaacacctatgattgtttgttttctgcagatttacaattttgtaattcctgtttagcgattgtcaagccacaactctaacaaacaaaccattatgtgtgctagtgccaaagtctgcagactgctttattttttctcttaatttcatgtacctgtcactttacacatttaaatccccataaatgaagggtatgatgggtgactcagcccacactgctgctatatttcttactaatgcaattggtaaaaccgattagtattggaaatatactgtttcttaacaagaaaagtgtctttatttcttatccaatttagtgagatgtgaaggagactgatgacatggggatagttcttacacaattgaggaatggggtgggggcaataggaggatgtatattttgacttgtaaaaaaatcttaaagtgcatgaaacttttatctgatagtcatttgcactctccttcccatctgtgattccttgtgtgctaacatataaagaaaccaagagaactatcttccttctccagaaaccttaaaaatacagttaagggccctaaaaacgatattgaaaagaaaataaacttgtttcttttttgttgttgttgttattgaagtttgggcaggagaaaagattgctagaaaatgacatataagaactttagaaaagctt

SEQ ID NO: 1259 - DNA, 2051 bp; single-stranded, linear
  immediate source library: GENBANK
  immediate source clone: g219866
cgccactttgctggagcattcactaggcgaggcgctccatcggactcactagccgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaactttggggacatcccttgccggctggtgctcttcatgtttgccatgaaccgccagggcagcatcatcttcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggccctgcaaatgtgtgcatcagcttcagcatctgccataccttccggtggcacgaagctatgttcctcctggagttcctcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctcaaataaccattccaagaagggacattgtcaccaagaaccagcatctctggagaaacagttgggctgttgcatcgagtaatgtcactggactcggcctaaggtttcctggaacttccagattcagagaatctgatttagggaaactgtggcagatgagtgggagactggttgcaaggtgtgaccacaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggggggggctcagctcctcgggtgatatctagcctgcttgtgagctctagcagggataaggagagctgagattggagggaattgtgttgctcctggaggaagcccaggcatcattaaacaagccagtaggtcacctggcttccgtggaccaattcatctttcagacaagctttagagaaatggactcagggaagagactcacatgctttggttagtatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgagcagttaaaacggcttcaggatagaaagctgtttcccacctgtttcgttttaccattaaaagggaaacgtgcctctgccccacgggtagagggggtgcacgttcctcctggttccttcgcttgtgtttctgtacttaccaaaaatctaccacttcaataaattttgataggagacaaaaaaaaaa

SEQ ID NO: 1260 - DNA, 1367 bp; single-stranded, linear
  immediate source library: GENBANK
  immediate source clone: g219991
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagaccagtacaactcactgatcatattagggcagggccctcttaagatcaggtgggttgggcgggacatcctctgctaccatctcattaaaaggcccttcacctctggacaagtcatctgcaacaactgacttccaagatccttttgtgactcctccaaatgactttggttcccgtgttgtacctgacttccacatggccttctctcctggtccctggtgctgtttgggcctctgctcccatgctcatacctcttcttactccaattac

SEQ ID NO: 1261 - DNA, 1347 bp; single-stranded, linear
  immediate source library: GENBANK
  immediate source clone: g220080
gggggaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcagctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacacc

SEQ ID NO: 1262 - DNA, 1486 bp; single-stranded, linear
  immediate source library: GENBANK
  immediate source clone: g237994
ccaggacccagatgacaaaggggggttgtgtacagataggtagggctttacgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctg

SEQ ID NO: 1263 - DNA, 2791 bp; single-stranded, linear
  immediate source library: GENBANK
  immediate source clone: g23878
tgcgttggggtgaggccctcacttcatccggcgactagcaccgcgtccggcagcgccagccctacactcgcccgcgccatggtcttcatctctcgacctcgtgatgggccgccgcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccgctttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcaccttactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtggtttatacctcgcagatacaagaatctttatgaatatacaattctttttccttctacagcttagctccgtcttttcaaccacgaacatttaaaacccgacctactagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtacccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacacgaatggagaatgggttatataaagactgcctgctattgacagaaatgcatttgtaattcatgaaaataaatgtacatcttctatcttcaaaaaaaaaaaaaaaaaaa

SEQ ID NO: 1264 - DNA, 2416 bp; single-stranded, linear
  immediate source library: GENBANK
  immediate source clone: g244209
ttttgtatttgttgcaccctaagtctgttcatttccttctcctcagctgacatttggagcatagcagtcgatgatgcccacacagacactgcctgagactcacgcccctggagaaacgcagatttccttattttccaggtcaagtcctgccagccatagaaaggacttctttggtgccaactgctgtgaaatgcctgccttggaaatctcagtgctcccttgtacctgtctgagcccagggaaatgccatactgtggcactgctgcatcctgtatggctacccaaggatgcccaggactggtttgaaagagatgagacatggccaggtgcgtggctcacgcttgtaatccagcactttgggaggtcaaggcagtggatcacaaggtcagagttgagaccagccaggccaatatggtgaaaaccccatctctactaaaaatacaaaaaattagccgggcaatggtggtgggtgcctgtagttccagctagtcaggaggccgaggcaggagaatcgcttgaacctggaaggtggaggttccagtgagctgagatcgcgccactgcactccagcctgggtgacagagtgagactccaactcaaaaaaaaaaaaaaaaaagagatgagacactagtgtctcatgagtagaacctggaccagacacaaatctccattcccaatgtttagtgcctcattagtgcccaacaacaagatattgggtctatgtgggtaggcctggggcatcctgtacaacaggagatgtgttaggggagggagaacagatcacaaattcatggagagctatttgcagagcagatactcccatccactctgatatgtagttaatgttcagctgttcctaaaaagcacacccaacaatgggtgttctattccagcctaggaaaatgtagaggcaaggggtctgaggccagaggacaccactagatggaccactgctcctgactgtgatgttgtggcccactcaggtcccagcaccccatggtctgggggaaaatttgctggttcagccagagggctggatggacagtgtttgctgagtcacagatatctctctcatgtagcctttgtctccacagtggtgaccaggaggcacagaacccaaacctggtatctcagctctgtggcgtctttcttcaaaatgagacgaatgaaaccatacatatgcagatgagcatggcagtgggacagcaggccctgcccttgaatatcattgcccccaaggctgtgctggtctccctctgtggggtcttattgaatggcactgtcttctggctgctttgctgtggggccacgaatccctacatggtatacatcctccacctggtcgctgctgacgtgatctatctttgctgctcggcagtggggttcttacaggtgactctgctaacttatcatggagtcgtgttttttatccctgatttcctggccatattgtctcccttctcctttgaggtgtgtctctgtctcctggtggccatcagcacagagcggtgtgtgtgtgtcctcttccccatctggtacagatgccaccgcccaaaatacacatctaatgttgtctgcaccctcatctggggcctgcctttttgcatcaacatagtaaaatcacttttcctaacttactggaaacatgtaaaggcatgtgtcatatttctaaagctttctgggctcttccatgctatcctttcacttgtgatgtgtgtgtcgagtctgactctactcattagattcctgtgctgctcccagcagcaaaaggccaccagggtctatgcggtggtgcagatctcggcccccatgttcctactctgggccctacccctgagcgtggcacccctcataacagatttcaaaatgtttgtcaccacctcctatttaatttccttgttcctcattataaacagcagcgccaaccctatcatttatttctttgtggggagcctcagaaagaaaaggctgaaggaatctctcagagtgattctccaacgggcgttagcagataagccagaggtggggaggaacaaaaaggcagctggcatcgacccaatggagcaaccacactctactcagcatgtggagaaccttcttcccagggagcacagggtcgatgtggaaacataatttcccacatctgagctggggaattgtacacatagtaacccagcctgttctgcatcataaggctgctgcatcaaatcaatgctttattctaatcaagttcagctttcatggactttcaaaacaaccccttgctgtttgtggttggaagagacattaacttccttcctaggcagtaagcccagtttgaatgtgctccagttccaacgatgaggggaatgggacccagtgagactttcctggtacctgtggaatccaaataaagaccatacaaaggcatgaattc

SEQ ID NO: 1265 - DNA, 600 bp; single-stranded, linear
  immediate source library: GENBANK
  immediate source clone: g246904
ctgcagaccggtggcgatggccatcctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtgcgttcccccgcgccctcccagccctgggccaacctcaccaaccagttcgtgcagccgtcctggcgtatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtgaggagaggacagacagagaggaaagagggagaa

SEQ ID NO: 1266 - DNA, 739 bp; single-stranded, linear
  immediate source library: GENBANK
  immediate source clone: g249370
tgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccaggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaaaaaaaaaaaaaaa

SEQ ID NO: 1267 - DNA, 1267 bp; single-stranded, linear
  immediate source library: GENBANK
  immediate source clone: g256154
gagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgcggtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctccccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagacccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggc

SEQ ID NO: 1268 - DNA, 1739 bp; single-stranded, linear
  immediate source library: GENBANK
  immediate source clone: g260878
aatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctttgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacgggctcccggagcgtgtggagctggcacccctgcctccttggcagccggtgggccagaacttcaccctgcgctgccaagtggagggtgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtgctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaaccctaaaaaaaaaaaaaaaaa

SEQ ID NO: 1269 - DNA, 1616 bp; single-stranded, linear
  immediate source library: GENBANK
  immediate source clone: g28417
cttgctcctcaggcagaggctgagtccgcacatcacctccaggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctca

SEQ ID NO: 1270 - DNA, 2416 bp; single-stranded, linear
  immediate source library: GENBANK
  immediate source clone: g285994
gaacagtgttaccttggagcctacaatgagaggtatttcaaaatgagtgaagcatgactctcacagatgaaggcctagacgcaggatctttaatggaaaaacacttgggccacttcaagacgacaaacgctcactgggcaaaacaccttcactgaaaagagacctcatattatgcaaaaaaaatcttaagaggcctctgccttcagaagttacaagatgatcaattcaacctccacacagcctccagatgaatcctgctctcagaacctcctgatcactcagcagatcattcctgtgctgtactgtatggtcttcattgcgggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggtctctgccgtgctcttctacgtcaacatgtacgtcagcattgtgttctttgggctcatcagctttgacaggtattataaaattgtaaagcctctttggacttctttcatccagtcagtgagttacagcaaacttctgtcagtgatagtatggatgctcatgctcctccttgctgttccaaatattattctcaccaaccagagtgttagggaggttacacaaataaaatgtatagaactgaaaagtgaactgggacggaagtggcacaaagcatcaaactacatcttcgtggccatcttctggattgtgtttcttttgttaatcgttttctatactgctatcacaaagaaaatctttaagtcccaccttaagtcaagtcggaattccacttcggtcaaaaagaaatctagccgcaacatattcagcatcgtgtttgtgttttttgtctgttttgtaccttaccatattgccagaatcccctacacaaagagtcagaccgaagctcattacagctgccagtcaaaagaaatcttgcggtatatgaaagaattcactctgctactatctgctgcaaatgtatgcttggaccctattatttatttctttctatgccagccgtttagggaaatcttatgtaagaaattgcacattccattaaaagctcagaatgacctagacatttccagaatcaaaagaggaaatacaacacttgaaagcacagatactttgtgagttcctaccctcttccaaagaaagaccacgtgtgcatgttgtcatcttcaattacataacagaaatcaataagatatgtgccctcatcataaatatcatctctagcactgccatccaatttagttcaataaaattcaaatataagtttccatgcttttttgtaacatcaaagaaaacatacccatcagtaatttctctaatactgacctttctattctctattaataaaaaattaatacatacaattattcaattctattatattaaaataagttaaagtttataaccactagtctggtcagttaatgtagaaatttaaatagtaaataaaacacaacataatcaaagacaactcactcaggcatcttctttctctaaataccagaatctagtatgtaattgttttcaacactgtccttaaagactaacttgaaagcaggcacagtttgatgaagggctagagagctgtttgcaataaaaagtcaggtttttttcctgatttgaagaagcaggaaaagctgacacccagacaatcacttaagaaaccccttattgatgtatttcatggcactgcaaaggaagaggaatattaattgtatacttagcaagaaaattttttttttctgatagcactttgaggatattagatacatgctaaatatgttttctacaaagacttacgtcatttaatgagcctggggttctggtgttagaatatttttaagtaggctttactgagagaaactaaatattggcatacgttatcagcaacttcccctgttcaatagtatgggaaaaataagatgactgggaaaaagacacacccacaccgtagaacatatattaatctactggcgaatgggaaaggagaccattttcttagaaagcaaataaacttgatttttttaaatctaaaatttacattaatgagtgcaaaataacacataaaatgaaaattcacacatcacatttttctggaaaacagacggattttacttctggagacatggcatacggttactgacttatgagctaccaaaactaaattctttctctgctattaactggctagaagacattcatctatttttcaaatgttctttcaaaacatttttataagtaatgtttgtatctatttcatgctttactgtctatatactaataaagaaatgttttaatactg

SEQ ID NO: 1271 - DNA, 594 bp; single-stranded, linear
  immediate source library: GENBANK
  immediate source clone: g28638
gtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcac

SEQ ID NO: 1272 - DNA, 2613 bp; single-stranded, linear
  immediate source library: GENBANK
  immediate source clone: g28679
gcgcgccttctccagtccgcggtgccatggcccccgcccgtctgttcgcgctgctgctgctcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtactttctaaaaaaaaaaaaaaaaaaa

SEQ ID NO: 1273 - DNA, 810 bp; single-stranded, linear
  immediate source library: GENBANK
  immediate source clone: g288396
agcagaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactaaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtaaaaaa

SEQ ID NO: 1274 - DNA, 1689 bp; single-stranded, linear
  immediate source library: GENBANK
  immediate source clone: g288931
ttcaggggctttctggtgcccttgacagtgacctgcagcaagggagtcagaagacagatgtagaaatcaagagtgaccatccacgggattgacttggattgccactcaagcggtcctctcatggaatgttggtgaggccctctgccagggaagcaatctggctgtgcaaagtgctgcctggtggggaggactcctggaaatctgactgacccctattccctgcttaggaacttgaggggtgtcagagcccctgatgtgctttctcttaggaagatgaggactctgaacacctctgccatggacgggactgggctggtggtggagagggacttctctgttcgtatcctcactgcctgtttcctatcgctgctcatcctgtccacgctcctggggaacacgctggtctgtgctgccgttatcaggttccgacacctgcggtccaaggtgaccaacttctttgtcatctccttggctgtgtcagatctcttggtggcagtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcctgaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcggtcatattggactatgacactgacgtctctctggagaagatccaacccatcacacaaaacggtcagcacccaacctgaactcgcagatgaatcctgccacacatgctcatcccaaaagctagaggagattgctctggggtttgctattaagaa

SEQ ID NO: 1275 - DNA, 1413 bp; single-stranded, linear
  immediate source library: GENBANK
  immediate source clone: g291876
gagtatctggatgtcttggattttcttcccattctgttctgttctgttctcctaataccatctcgttactagacgtaggcattggacgtgacaatcaactgcatttgaactgagaagaagaaatattaaagacacagtcttcagaagaaatggctcaaaggcagcctcactcacctaatcagactttaatttcaatcacaaatgacacagaatcatcaagctctgtggtttctaacgataacacaaataaaggatggagcggggacaactctccaggaatagaagcattgtgtgccatctatattacttatgctgtgatcatttcagtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacagatacaaggcagttgtgaagccacttgagcgacagccctccaatgccatcctgaagacttgtgtaaaagctggctgcgtctggatcgtgtctatgatatttgctctacctgaggctatattttcaaatgtatacacttttcgagatcccaataaaaatatgacatttgaatcatgtacctcttatcctgtctctaagaagctcttgcaagaaatacattctctgctgtgcttcttagtgttctacattattccactctctattatctctgtctactattccttgattgctaggaccctttacaaaagcaccctgaacatacctactgaggaacaaagccatgcccgtaagcagattgaatcccgaaagagaattgccagaacggtattggtgttggtggctctgtttgccctctgctggttgccaaatcacctcctgtacctctaccattcattcacttctcaaacctatgtagacccctctgccatgcatttcattttcaccattttctctcgggttttggctttcagcaattcttgcgtaaacccctttgctctctactggctgagcaaaagcttccagaagcattttaaagctcagttgttctgttgcaaggcggagcggcctgagcctcctgttgctgacacctctcttaccaccctggctgtgatgggaacggtcccgggcactgggagcatacagatgtctgaaattagtgtgacctcgttcactgggtgtagtgtgaagcaggcagaggacagattctagcttttcaaggaaaaatgctgcttctcctcccagcgtgtgtatccgactctaagctgtgtgcagg

SEQ ID NO: 1276 - DNA, 1504 bp; single-stranded, linear
  immediate source library: GENBANK
  immediate source clone: g291945
atggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgcagacgcccaccaactccttcatcgtgagcctggcggccgccgacctcctcctcgctctcctggtgctgccgctcttcgtctactccgaggtccagggtggcgcgtggctgctgagcccccgcctgtgcgacgccctcatggccatggacgtcatgctgtgcaccgcctccatcttcaacctgtgcgccatcagcgtggacaggttcgtggccgtggccgtgccgctgcgctacaaccggcagggtgggagccgccggcagctgctgctcatcggcgccacgtggctgctgtccgcggcggtggcggcgcccgtactgtgcggcctcaacgacgtgcgcggccgcgaccccgccgtgtgccgcctggaggaccgcgactacgtggtctactcgtccgtgtgctccttcttcctaccctgcccgctcatgctgctgctctactgggccacgttccgcggcctgcagcgctgggaggtggcacgtcgcgccaagctgcacggccgcgcgccccgccgacccagcggccctggcccgccttcccccacgccacccgcgccccgcctcccccaggacccctgcggccccgactgtgcgccccccgcgcccggccttccccggggtccctgcggccccgactgtgcgcccgccgcgcccggcctccccccggacccctgcggccccgactgtgcgccccccgcgcccggcctcccccaggacccctgcggccccgactgtgcgccccccgcgcccggccttccccggggtccctgcggccccgactgtgcgccccccgcgcccggcctcccccaggacccctgcggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagggtcctgccggtggtggtcggggccttcctgctgtgctggacgcccttcttcgtggtgcacatcacgcaggcgctgtgtcctgcctgctccgtgcccccgcggctggtcagcgccgtcacctggctgggctacgtcaacagcgccctcaaccccgtcatctacactgtcttcaacgccgagttccgcaacgtcttccgcaaggccctgcgtgcctgctgctgagccgggcacccccggacgccccccggcctgatggccaggcctcagggaccaaggagatggggagggcgcttttgtacgttaattaaacaaattccttccc

SEQ ID NO: 1277 - DNA, 999 bp; single-stranded, linear
  immediate source library: GENBANK
  immediate source clone: g291977
atggtgaactccacccaccgtgggatgcacacttctctgcacctctggaaccgcagcagttacagactgcacagcaatgccagtgagtcccttggaaaaggctactctgatggagggtgctacgagcaactttttgtctctcctgaggtgtttgtgactctgggtgtcatcagcttgttggagaatatcttagtgattgtggcaatagccaagaacaagaatctgcattcacccatgtactttttcatctgcagcttggctgtggctgatatgctggtgagcgtttcaaatggatcagaaaccattatcatcaccctattaaacagtacagatacggatgcacagagtttcacagtgaatattgataatgtcattgactcggtgatctgtagctccttgcttgcatccatttgcagcctgctttcaattgcagtggacaggtactttactatcttctatgctctccagtaccataacattatgacagttaagcgggttgggatcatcataagttgtatctgggcagcttgcacggtttcaggcattttgttcatcatttactcagatagtagtgctgtcatcatctgcctcatcaccatgttcttcaccatgctggctctcatggcttctctctatgtccacatgttcctgatggccaggcttcacattaagaggattgctgtcctccccggcactggtgccatccgccaaggtgccaatatgaagggagcgattaccttgaccatcctgattggcgtctttgttgtctgctgggccccattcttcctccacttaatattctacatctcttgtcctcagaatccatattgtgtgtgcttcatgtctcactttaacttgtatctcatactgatcatgtgtaattcaatcatcgatcctctgatttatgcactccggagtcaagaactgaggaaaaccttcaaagagatcatctgttgctatcccctgggaggcctttgtgacttgtctagcagatattaa

SEQ ID NO: 1278 - DNA, 1345 bp; single-stranded, linear
  immediate source library: GENBANK
  immediate source clone: g292054
aaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaagggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattg

SEQ ID NO: 1279 - DNA, 1643 bp; single-stranded, linear
  immediate source library: GENBANK
  immediate source clone: g292056
ggaattccctgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccacggctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccactcactgagaaatctggtgtaaacaaaaaggctctcaacacaattattcttattattgttgtgtttgttctctgtttcacaccttaccatgttgcaattattcaacatatgattaagaagcttcgtttctctaatttcctggaatgtagccaaagacattcgttccagatttctctgcactttacagtatgcctgatgaacttcaattgctgcatggacccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtgaaatggattgtattttggtttatagtgacgtaaactgtatgacaaactttgcaggacttcccttataaagcaaaataattgttcagcttccaattagtattcttttatatttctttcattgggcgctttcccatctccaactcggaagtaagcccaagagaacaacataaagcaaacaacataaagcacaataaaaatgcaaataaatattttcatttttatttgtaaacgaatacaccaaaaggaggcgctcttaataactcccaatgtaaaaagttttgttttaataaaaaattaattattattcttgccaacaaatggctagaaaggactgaatagattatatattgccagatgttaatactgtaacatactttttaaataacatatttcttaaatccaaatttctctcaatgttagatttaattccctcaataacaccaatgttttgttttgtttcgttctgggtcataaaactttgttaaggaactcttttggaataaagagcaggatgctgcggaattc

SEQ ID NO: 1280 - DNA, 894 bp; single-stranded, linear
  immediate source library: GENBANK
  immediate source clone: g292276
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtaacggagacggccgaccccggggcacaggcccagcaaggactggggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaa

SEQ ID NO: 1281 - DNA, 1086 bp; single-stranded, linear
  immediate source library: GENBANK
  immediate source clone: g292418
atggatctgcacctcttcgactacgccgagccaggcaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcagcggcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtgtcggagacggagtactccgccttggagcaaaacgccaag

SEQ ID NO: 1282 - DNA, 2305 bp; single-stranded, linear
  immediate source library: GENBANK
  immediate source clone: g29370
gaattcatgccgcgtttctgtgttggacaggggtgactttgtgccggatggcttctgtgtgagagcgcgcgcgagtgtgcatgtcggtgagctgggagggtgtgtctcagtgtctatggctgtggttcggtataagtctaagcatgtctgccagggtgtatttgtgcctgtatgtgcgtgcctcggtgggcactctcgtttccttccgaatgtggggcagtgccggtgtgctgccctctgccttgagacctcaagccgcgcaggcgcccagggcaggcaggtagcggccacagaagagccaaaagctcccgggttggctggtaagcacaccacctccagctttagccctctggggccagccagggtagccgggaagcagtggtggcccgccctccagggagcagttgggccccgcccgggccagcctcaggagaaggagggcgaggggaggggagggaaaggggaggagtgcctcgccccttcgcggctgccggcgtgccattggccgaaagttcccgtacgtcacggcgagggcagttcccctaaagtcctgtgcacataacgggcagaacgcactgcgaagcggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcctgctgaggcgcccccagccagtgcgcttacctgccagactgcgcgccatggggcaacccgggaacggcagcgccttcttgctggcacccaatagaagccatgcgccggaccacgacgtcacgcagcaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccccccaacagaacactaaacagactatttaacttgagggtaataaacttagaataaaattgtaaaattgtatagagatatgcagaaggaagggcatccttctgccttttttatttttttaagctgtaaaaagagagaaaacttatttgagtgattatttgttatttgtacagttcagttcctctttgcatggaatttgtaagtttatgtctaaagagctttagtcctagaggacctgagtc

SEQ ID NO: 1283 - DNA, 1242 bp; single-stranded, linear
  immediate source library: GENBANK
  immediate source clone: g297101
aagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcacacccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgctatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcgtgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagaccacatggagcacaaattcgggtaggatggagcctgtgtggccctcggaggactgaacaacga

SEQ ID NO: 1284 - DNA, 1361 bp; single-stranded, linear
  immediate source library: GENBANK
  immediate source clone: g297411
ctcgctcgctccccgctctggagtacgtgtctggcttgggagccgctcggacacgctggcttgggtctgccatcatggatgttctcgcagaggcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttagggtggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatggacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagaaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattcaaaaaaaaaaaaaaaaaa

SEQ ID NO: 1285 - DNA, 3067 bp; single-stranded, linear
  immediate source library: GENBANK
  immediate source clone: g298096
ggtgggtttatctcaaggcctgagtagccggtaacaaacgagggttcccgggattggaccgacgcaccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaaaaaaaa

SEQ ID NO: 1286 - DNA, 1062 bp; single-stranded, linear
  immediate source library: GENBANK
  immediate source clone: g298201
ggggccgccgagagccgcagcgccgctcgcccgccgccccccaccccgccgccccgcccggcgaattgcgccccgcgccctcccctcgcgcccccgagacaaagaggagagaaagtttgcgcggccgagcgggcaggtgaggagggtgagccgcgcggaggggcccgcctcggccccggctcagcccccgcccgcgcccccagcccgccgccgcgagcagcgcccggaccccccagcggcggccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatg

SEQ ID NO: 1287 - DNA, 1004 bp; single-stranded, linear
  immediate source library: GENBANK
  immediate source clone: g29850
gcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgcaggggtgcaggcagaagcggggagctatgcccagtcagtgccagcccctc

SEQ ID NO: 1288 - DNA, 2288 bp; single-stranded, linear
  immediate source library: GENBANK
  immediate source clone: g29878
ccgccgcccgccacactcgccccccgccccccccgcgcctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccacagtctcttggcgtgctggagggcatcctggatggaattgaagtgaatggaacagaagccaagcaaggtggaatgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctagatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacaggcaaacaactgaacttgctatggaaaggacagtgtgggaggctgggggagctgtgttctgcagttcccaggaccccatcctctcagaaggtaggggaagggcgggaggattgagaagggacaagccaccttgaccgtagggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggagttaaaatttatagtcattctaactgcactttggaaaccaagcaaggggagaagacaaatgaagaaaaactagacagagaaaaaaaaaaaa

SEQ ID NO: 1289 - DNA, 420 bp; single-stranded, linear
  immediate source library: GENBANK
  immediate source clone: g29887
ctcttgtcagctgtctttcagaagacctggtggggnaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggctggcagcccacaaaaaaagccatgaagaaagccacaaagagtagctgagttactgcccagaggctgggcccctgacatgtacctgcagaataataaagtcatcaatacctcaaaaaaaaaaaaaaaaaaaaa

SEQ ID NO: 1290 - DNA, 1398 bp; single-stranded, linear
  immediate source library: GENBANK
  immediate source clone: g299704
tagatggcaacctccctatctgcccgcaggtcatagaggcgacacgtagcgtcatctgaccctgaagcaaaggcatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaaggcacgaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacaggctgtaagaatcaaagtcaactgacatctatgctacatattattatatagtttgtactgagctattgaagtcccattaacttaaagtatatgttttcaaattgccattgctactattgcttgtcggtgtattttattttattgtttttgactttggaagagatgaactgtgtatttaacttaagctattgctcttaaaaccagggatcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaa

SEQ ID NO: 1291 - DNA, 2000 bp; single-stranded, linear
  immediate source library: GENBANK
  immediate source clone: g29980
tttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattg

SEQ ID NO: 1292 - DNA, 4080 bp; single-stranded, linear
  immediate source library: GENBANK
  immediate source clone: g30263
gaattcccagaccatgaccacgtgctcctggatgcccctgacatctgaagactttagaaggccaagccctgtatttctccctttcctgtggacataggtggtcaccaggtttcacagcccagggagcggtgtcacctctctggaatccagagtgagccaagctttagagcactgaggaagaggggcagggctgtggggaggttgcggtcaggacaggagtggggaggaggatgaggaggaggcatgggaggagcgaagggaacttagggagggagggaggtggttgggggtggaaagggagatacagacagaagaggaggggtagaaagaggaggaggagccagggcggggccagggagcaggtggggttgggggacacccaagtaggataaatgcacagctagcttctggcctgggcttcctgcctcagccttctgctgctttgctctctgggagatccagctccttgctctgtgtcccagtagaacatgatgtggcccatgcacaccccactgctgctgctgactgccttgatggtggccgtggccgggagtgcctcggcccaatctaggaccttggcaggtggcatccatgccacagacctcaatgacaagagtgtgcagtgtgccctggactttgccatcagcgagtacaacaaggtcattaataaggatgagtactacagccgccctctgcaggtgatggctgcctaccagcaggtgcgtgctaccaccaccctgggggtcctgagtcccagctgggttttttgcctcaccccccagagcactcccagcaaatcaacattatctaaaccgcagactcattcagctttctctgactgtctgctgatggtcttcatgccctaggacactccttggccgtgagtgcatgagttcagccctgtcctgtcccctcggcctcttttaacctgcagcagccactgtgtctgtaccatgactgtggcatttcccagggtccagcaggtgtggatggagactgtgctgactctgggtgggcttgatgctgctcaggatgagatccaggccacgaggttcatcttcctccctgagtcctctccacaggggccacacgggaacctgactccttgtcctggatagccccgcttccctcccaagtcacgcccctggcacagcccgttatggctagtggccttcactctcaggctggctgaccaccccctacagcccaggacagctgagttcctgctggggtagagcatgcctgaccctgcctctgccagctaacgcagagttagacctcagcaaaatgaggacagcaatcacccagcagagtgaaggaggtggttgggtccagagggaggaagcttcagcagggctaccgagcccagcttgacctacgtcccatggcagagcagcagtgacacagcgaccacagggctatatggcctgccagcctttagagctcctccaccttctcttggaaagtcagaggagtccagaccagccctgtttctcctcctgcagccctctccctgcacaggaggggcattccctggtgctgtggtccctgctggcctgcactccctcttaagtgtgtcactcactgggagtgaagcacagaatgatgtagatcgttgggccctggagcctattttacagagcagcagactgacaccggagggatcacaggacttccatgtggttctacaggacttgtgtgtggttccacagggcaaggtctagcaccctggtcccagggtccctcatcccatgcttctccacagttctgacaagtcatgttttggggcggcactgtgcagggaaagcattcagttctcttctgaagttgcaaccctaagacatgcaggtgtgtgactcactttagaaatattgccttgaaaatcacacctggaatggaggcatgcaggaggcaatgtttattggcctaaaacatcaatgtatgtgagcatctcatctcctactgagaaatgaggaaaaatacctctgggttaaatggcaggaatgagatgctctgtggactgaatgccaggagctggaagttagctgaaatttcatcatcaggtggcagccttcctaggatgggaccagtgtccctgccccctgagcacaggtagcagaattcagttaatcctttgctgtgggaaagagcattcacttggtgcttagaccctgccctgcaagcctggtgccaggactgtttctttgtcccaccctggctggttccccagagctgtgccttctgttcctgaatccagtgaagggggttttaggccctggcttccatctgccctgcccctgcttctctttctactgggctgcatgagacagcttgcttgagatacccagagaaaacaagttactaggaaggactgggacacactaccactgccagccagcaggagaaggtggcttgtgtgccttttgggtgacagtgtgggcatgaagccccaggcaagcccagtgactcagtcacagtgaagtgcctgcgtgtgcatgaaactgacagcatgctgcccctgcttcctgctcttccacgcgtgtagatcgtgggtggggtgaactactacttcaatgtgaagttcggtcgaaccacatgcaccaagtcccagcccaacttggacaactgtcccttcaatgaccagccaaaactgaaagaggtatgtgcctgatgtgggtcaggggcatcaagtaccgcagagcagtgtgtgcatgtgtgtgtgtgtatgtgtgtgtgcacgcatctgtactcctgcacatgctttggagggcatgtgtgcatgtgtgcagatatttgtggggccacgtatgcaaggatgtattcatgtgcatgggaggatgcatgtgtgtttggcacacatgtgcagatgtgtattgtgaagtcaatgaatgtgtttgtgcatatggagttttgtgtatgcatgaatgaatgtgtgggatggtgtacacatgtggctatgcatgtagaaagatgcatatgtgtgcatacatgaggaagatgcacaggagtgtgtgtgtgcatgtgtgtggatgtgtgaaggagtatgtgggttcatgcatatattcgtttgggtgagggttgctgtgagttaatatagatgcctatgtgtgtgcagatggagtgggtgtggataggggtgatgaatttgttttgctaggaagactttagcttggtaatggttactgggaggtcaactctgcctgctttggggtgttgtctgttggactggaggaagaagctgctgggctgggttctggtcagaaagaaggggctctgtctaaccccagcctcaggcacctgcctgcagccacagccactctgagcacattagaaggaattaaatgcctgttagctgagaagccctggacctgccccagctcacccaacatcagcctctccaagaacccaggatttctttcgaggtctctgctcaaggcagagccacactctccttgtcatctcctcaccacctcgggcactttgagttgcaatttccagttccctgggttcttccctctggcccctcttagtgctggcctgggtgctggaggtggaaggagctggaggcagtgagctgcctcccctgtcctgcacccctgaggctcccaaggccttgcacaggctgctcctcatagggctgcgctgggacaggaatcctgcaggctggggtgaaggcccaatgtcacctggtgacttggagccttgggaggggcaatggaacagtcactgcccagttgggctcagtgccctggaactcggcaggggtaggttggggtcagggggcagtgtctcatctccaaccattttcacccccattctgatgtcccattcctgggcatctttggctttaactgtaacccacagtcattttctccatctctttcttttcacaggaagagttctgctctttccagatcaatgaagttccctgggaggataaaatttccattctgaactacaagtgccggaaagtctaggggtctgtgcaaggcctgtcacactgaccacctcctactcccaccccctgtagtgctcccacccctggactggtggcccccaccctgggggaggtctcctcat

SEQ ID NO: 1293 - DNA, 1301 bp; single-stranded, linear
  immediate source library: GENBANK
  immediate source clone: g303596
gggcacgcgcaccaccgcccgcagcgcagcccgcgcccgcgcaggccccgcagccggcccagcccgccgccaccggccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaccc

SEQ ID NO: 1294 - DNA, 1258 bp; single-stranded, linear
  immediate source library: GENBANK
  immediate source clone: g306472
cggcttgtcacctgccctaggagacgcagccgccggaccctgcccagggcacccacgcctcggcgaccaccatgtcccagaccaaaatgctgaaggtccgcgtgaccctcttctgcatcctggcaggcatcgtgctggccatgacagccgtggtaaccgaccactgggctgtgctgagcccccacatggagcaccacaacactacctgcgaggcggcccacttcggcctctggcggatttgtaccaagcgcatccccatggacgacagcaagacctgcgggcccatcaccctgcccggggagaagaactgttcctacttcaggcattttaaccccggcgagagctcggagatcttcgaattcaccactcagaaggagtacagcatctcggcagccgccatcgccatcttcagccttggcttcatcatcctgggcagcctctgtgtcctcctgtccctcgggaagaagagggactatctgctgcgacccgcgtccatgttctatgcctttgcaggtctctgcatcctcgtctcggtggaggtcatgcggcagtcggtgaagcgcatgattgacagtgaggacaccgtctggatcgagtactattactcctggtcctttgcctgcgcctgtgccgccttcatcctcctctttctcggcggtctcgccctcctgctgttctccctgcctcgaatgccccggaacccatgggagtcctgcatggatgctgagcccgagcactaaccctctgcggccctagcgaccctcaggcttcttccccaggaagcggggtcttggcctggaaccttccagagaggaggcgggagcaattttagccccaccctgctcccatctgcccccctgcaacagctgcaggctgcttcctctctctgagttcctctgggctgcgcaggctcccctgggaatagagcaagacgtgagtcctaacctggccacagttgggggagcagagccagcaggtggacaggtgtttgcaggggcccaacttcccctggagctcagaggggggcccactgtaccagcctctgataagctgcctccagttgtcctttatgaacattgcagggacaacctgtgtttgccagctgggtgttccgtgtaaatagccagcctgtctctttctcggtgataaaacacacgcgctcctggagcccaggcctccccctccttggcttccaggagcctggaagcatttttaactgggtagaatctgactgtggcttgaaataaaaagctctcag

SEQ ID NO: 1295 - DNA, 1344 bp; single-stranded, linear
  immediate source library: GENBANK
  immediate source clone: g306488
atggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctga

SEQ ID NO: 1296 - DNA, 1393 bp; single-stranded, linear
  immediate source library: GENBANK
  immediate source clone: g306490
cattagaggaatgagccgggagtgagcaattcaccagctctccagcacttggtggaaagcagcaggcaaggatggatgtggttgacagccttcttgtgaatggaagcaacatcactcctccctgtgaactcgggctcgaaaatgagacgcttttctgcttggatcagccccgtccttccaaagagtggcagccagcggtgcagattctcttgtactccttgatattcctgctcagcgtgctgggaaacacgctggtcatcaccgtgctgattcggaacaagcggatgcggacggtcaccaacatcttcctcctctccctggctgtcagcgacctcatgctctgtctcttctgcatgccgttcaacctcatccccaatctgctcaaggatttcatcttcgggagcgccgtttgcaagaccaccacctacttcatgggcacctctgtgagtgtatctacctttaatctggtagccatatctctagagagatatggtgcgatttgcaaacccttacagtcccgggtctggcagacaaaatcccatgctttgaaggtgattgctgctacctggtgcctttcctttaccatcatgactccgtaccccatttatagcaacttggtgccttttaccaaaaataacaaccagaccgcgaatatgtgccgctttctactgccaaatgatgttatgcagcagtcctggcacacattcctgttactcatcctctttcttattcctggaattgtgatgatggtggcatatggattaatctctttggaactctaccagggaataaaatttgaggctagccagaagaagtctgctaaagaaaggaaacctagcaccaccagcagcggcaaatatgaggacagcgatgggtgttacctgcaaaagaccaggcccccgaggaagctggagctccggcagctgtccaccggcagcagcagcagggccaaccgcatccggagtaacagctccgcagccaacctgatggccaagaaaagggtgatccgcatgctcatcgtcatcgtggtcctcttcttcttgtgctggatgcccatcttcagcgccaacgcctggcgggcctacgacaccgcctccgcagagcgccgcctctcaggaacccccatttccttcatcctcctcctgtcctacacctcctcctgcgtcaaccccatcatctactgcttcatgaacaaacgcttccgcctcggcttcatggccaccttcccctgctgccccaatcctggtcccccaggggcgaggggagaggtgggggaggaggaggaaggcgggaccacaggagcctctctgtccaggttctcgtacagccatatgagtgcctcggtgccaccccagtgagatgtcccctgaccctccaccgcagaaggaaggca

SEQ ID NO: 1297 - DNA, 1111 bp; single-stranded, linear
  immediate source library: GENBANK
  immediate source clone: g306688
atggcatctctgagtcagctgagtagccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccaacaaaccctctctcctgacccggcacatctggagctgaagcgttactacagcatctgccaggacactgccttgggtggaccaggcttccaagaaagaggaggagagttgaaaagagaggagaagactcggaattccctgagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 1298 - DNA, 2557 bp; single-stranded, linear
  immediate source library: GENBANK
  immediate source clone: g306804
cagagggaggaagaagcggcggcgcggcggcggcggctcctctttgcagagggggaaactcttgggctgagagcaggaacaacgcggtaggcaaggcgggctgctggctcccccggctccggcagcagcggcggcagcccgagcagcggcagcagcagcggcagcaccccaggcgctgacagccccgccggccggctccgttgctgaccgccgactgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttttgtgaaaccaggcctgggctggagtgttacattcagttcctggactccgtggcagaatatgaagttactccagatgaaaaactgggagagaaagggaaggaaattatgaccaagtacctcaccccaaagtcccctgttttcatagcccaagttggccaagacctggtctcccagacggaggagaagctcctacagaagccgtgcaaagaactcttttctgcctgtgcacagtctgtccacgagtacctgaggggagaaccattccacgaatatctggacagcatgttttttgaccgctttctccagtggaagtggttggaaaggcaaccggtgaccaaaaacactttcaggcagtatcgagtgctaggaaaagggggcttcggggaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccgagatctgaaacctgaaaacatcctgttagatgattatggccacattaggatctcagacctgggcttggctgtgaagatccccgagggagacctgatccgcggccgggtgggcactgttggctacatggcccccgaagtcctgaacaaccagaggtacggcctgagccccgactactggggccttggctgcctcatctatgagatgatcgagggccagtcgccgttccgcggccgtaaggagaaggtgaagcgggaggaggtggaccgccgggtcctggagacggaggaggtgtactcccacaagttctccgaggaggccaagtccatctgcaagatgctgctcacgaaagatgcgaagcagaggctgggctgccaggaggagggggctgcagaggtcaagagacaccccttcttcaggaacatgaacttcaagcgcttagaagccgggatgttggaccctcccttcgttccagacccccgcgctgtgtactgtaaggacgtgctggacatcgagcagttctccactgtgaagggcgtcaatctggaccacacagacgacgacttctactccaagttctccacgggctctgtgtccatcccatggcaaaacgagatgatagaaacagaatgctttaaggagctgaacgtgtttggacctaatggtaccctcccgccagatctgaacagaaaccaccctccggaaccgcccaagaaagggctgctccagagactcttcaagcggcagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggaaggaggccgtccatcccgtcgacgtagaacctcgaggtttctcaaagaaatttccactcaggtctgttttccgaggcggccccgggcgggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttcggtatatttgtatttaaatgaagtgagactttgagggtgtatattttctgtgcagccactgttaagccatgtgttccaaggcattttagcggggagggggttatcaaaaaaaaaaaaaatgtgactcaagacttccagagcctcaaatgagaaaatgtctttattaaatgtagaaagtgatccatacttcaaaaaaaaa

SEQ ID NO: 1299 - DNA, 4079 bp; single-stranded, linear
  immediate source library: GENBANK
  immediate source clone: g307044
cctaggcaggcaacatagtgagaccccatctccaaaaaaacaaaacaaaacaaaacaaaaaaacaccaaaaaagctcccagaaagacctctgaatctttctggatctctcagtggagaccttggaaatctgaactttgacaatccctctcacagtggggccaaggaggaattaggcaagccaaaagaagtgaactttactcttctattgcctgtttgaattttgtatccaagcaagtgttacttaagtaatttaagagactggttcatcgaaaaaataaaactccccaaattcccatagctggtagactgtggtcacagccacagtgcactaagactatctgctcagcacttctggtgacccaaaagggtctgaggacaggagctcagagttgggtcagctgtccaggtactcagggttgtcacaggcaaaactgctggaactcagggcagcattgcaaatgcctcgccgctctcgaggccccttgcctgccgctggaattaaacccacccagatcttggaaactctgccctggacccttctcaataagtccatgagaaatcaaactctttcctttatgcgacactggattttccacaaagtaaaatcaagatgagtaaagatgtggtttctagatagtgcctgaaaaagcagagaccatggtgtcaggcgtcaccacttgggcctataaaagctgccacaagagcccaagccacaagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggtgagtgtcggctagccagggtcctagctatgagggctccagggtgggtgattcccaagatgaggtcatgagcaggctgggcctggtcctaagatgcctgtaggtcaggaaaaatctccatggaccaaggcccggcccagccatgagggagagaggagctgggctggggggctcagcactgtggatggacctatggaggtgtctggcagactccccagggactacctgctctcctggcctggccttgtctgccactgccagctcctactcagccattcctgaacagaggacagcagagaagggtccagcaccctcccagaaccatgtggcatttgccaactggattttgaccataacaatgcagccattctccccagcaccatcataggcccgcccttacaggaggattcgttagtagagtccgctccttgccccactagtaacagctcacatgtctgagcactgcttacaccaggcctggtgcacgtgctttatgtgtcatttcatcactgccagccacctcaagaggcaggtacgatgaacccattctgctaaggttcagtgaggttaagtgacagaggctggattcaagccaggcctggccaacaccagagtgtccatgctcctaactgcagtgttccctcaccatcagaaggcagggcatttaatacaccagatccccaccgcctcccatctgatttgtcttggtcaacagtggcccaggccatcctacttcactcgtccccaccctggcccttcccgcagcccctgtcctcctgccctgactatggcaagccttgcatgcagcttgtcccttactagtggtgtcaatttttttctctcagctccaagaccctaaacagtgggacctcacccctatgcctgctgttcaaagcagaaaacgaagctcaggaatgctgaggggctgccaggcctgcctctgtgccacaccagggatgcttgtggggcctgtgctggggcagacctggcctgggctgccagggcaggcccacaacccctgccagcactctgctcactgtcactttgctcccacaggctccgctctgcaatggcagcatggtatggagcatcaacctgacagctggcatggtaaggacctttgggtgcagggaggatggggcagaggctccaggccttgggcttatcttctctgagcctcccttccatggctggggttccaagcaagcttcaagtgctctcctccctcccgccataatctggccccttcccgcccaccacccagactcacctgcgccaggcatctcagccccatcttcctgcagactcacaaaaggcagctgcccaagcagggcctgacccctcggtgtcccctccccacagtactgtgcagccctggaatccctgatcaacgtgtcaggctgcagtgccatcgagaagacccagaggatgctgagcggattctgcccgcacaaggtctcagctggggtaaggcatcccccaccctctcacacccaccctgcaccccctcctgccaaccctgggctcgctgaagggaagctggctgaatatccatggtgtgtgtccacccaggggtggggccattgtggcagcagggacgtggccttcgggatttacaggatctgggctcaagggctcctaactcctacctgggcctcaatttccacatctgtacagtagaggtactaacagtacccacctcatggggacttccgtgaggactgaatgagacagtccctggaaagcccctggtttgtgcgagtcgtcccggcctctggcgttctactcacgtgctgacctctttgtcctgcagcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagataggcctgattgtatttgtctttcattttggcctttggggacactggtctgtggtctgaagactctgaggagctcttcgggaggctggtgggttggaggaggggactgggatggattacagcgagggtagggtgcagtgacctgggctgaatgcaagctagctcccgagggtggggacatggcctgaaggaagccccaccttctgtctgctgcaccagcaaggacggagaggcttgggcagactgtcagggttcaaggagggcatcaggagcagacggagacccaggaagtctcacaatcacatctcctgaggactggccagctgtgtctggcaccacccacacatccatgtctccctcacaacccaggaggccgatgagaactgtgaggctcagaaagcgtgggcggtttgcctaaggtcacgtagct

SEQ ID NO: 1300 - DNA, 2257 bp; single-stranded, linear
  immediate source library: GENBANK
  immediate source clone: g307152
aatcgaaagtagactcttttctgaagcatttcctgggatcagcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaatgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcct

SEQ ID NO: 1301 - DNA, 1554 bp; single-stranded, linear
  immediate source library: GENBANK
  immediate source clone: g307419
actgttctcattaaatttcttaaataaaaaggaaaactaaaaccttcaatctgaacctcatttttttaatctatagaatattctgggtaaacataacatacactttttaaaaattattctgaaaggaagagaaaagttcttgaagccttctctgaactgttttttctcttcccttgttacaggtatccatttttcagctatattaatcttttaaaacaaagaaaatggatttcttaaattcatctgatcaaaacttgacctcagaggaactgttaaacagaatgccatccaaaattctggtgtccctcactctgtctgggctggcactgatgacaacaactatcaactcccttgtgatcgctgcaattattgtgacccggaagctgcaccatccagccaattatttaatttgttcccttgcagtcacagattttcttgtggctgtcctggtgatgcccttcagcattgtgtatattgtgagagagagctggattatggggcaagtggtctgtgacatttggctgagtgttgacattacctgctgcacgtgctccatcttgcatctctcagctatagctttggatcggtatcgagcaatcacagatgctgttgagtatgccaggaaaaggactccaaagcatgctggcattatgattacaatagtttggattatatctgtttttatctctatgcctcctctattctggaggcaccaaggaactagcagagatgatgaatgcatcatcaagcacgaccacattgtttccaccatttactcaacatttggagctttctacatcccactggcattgattttgatcctttactacaaaatatatagagcagcaaagacattataccacaagagacaagcaagtaggattgcaaaggaggaggtgaatggccaagtccttttggagagtggtgagaaaagcactaaatcagtttccacatcctatgtactagaaaagtctttatctgacccatcaacagactttgataaaattcatagcacagtgagaagtctcaggtctgaattcaagcatgagaaatcttggagaaggcaaaagatctcaggtacaagagaacggaaagcagccactaccctgggattaatcttgggtgcatttgtaatatgttggcttcctttttttgtaaaagaattagttgttaatgtctgtgacaaatgtaaaatttctgaagaaatgtccaattttttggcatggcttgggtatctcaattcccttataaatccactgatttacacaatctttaatgaagacttcaagaaagcattccaaaagcttgtgcgatgtcgatgttagttttaaaaatgtttattattgaaggatgggggtttttgaggggaggaataactagatgaatgccaaataataaaacacttaagcttttagagggaaatacatgaaaactgctaaattgataaggctataatttatattttaatagcaatgtgaatataaaagttattgatcaccactattctagggtattcaaaattagaaaataatttatgtaggttataacatattt

SEQ ID NO: 1302 - DNA, 1634 bp; single-stranded, linear
  immediate source library: GENBANK
  immediate source clone: g307433
ctgcaggcaagcggtcgggtggggagggagggcgcaggcggcgggtgcgcgaggagaaagccccagccctggcagccccactggcccccctcagctgggatgttccccaatggcaccgcctcctctccttcctcctctcctagccccagcccgggcagctgcggcgaaggcggcggcagcaggggccccggggccggcgctgcggacggcatggaggagccagggcgaaatgcgtcccagaacgggaccttgagcgagggccagggcagcgccatcctgatctctttcatctactccgtggtgtgcctggtggggctgtgtgggaactctatggtcatctacgtgatcctgcgctatgccaagatgaagacggccaccaacatctacatcctaaatctggccattgctgatgagctgctcatgctcagcgtgcccttcctagtcacctccacgttgttgcgccactggcccttcggtgcgctgctctgccgcctcgtgctcagcgtggacgcggtcaacatgttcaccagcatctactgtctgactgtgctcagcgtggaccgctacgtggccgtggtgcatcccatcaaggcggcccgctaccgccggcccaccgtggccaaggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggcttcgtgttgtacacatttctcatgggcttcctgctgcccgtgggggctatctgcctgtgctacgtgctcatcattgctaagatgcgcatggtggccctcaaggccggctggcagcagcgcaagcgctcggagcgcaagatcaccttaatggtgatgatggtggtgatggtgtttgtcatctgctggatgcctttctacgtggtgcagctggttaacgtgtttgctgagcaggacgacgccacggtgagtcagctgtcggtcatcctcggctatgccaacagctgcgccaaccccatcctctatggctttctctcagacaacttcaagcgctctttccaacgcatcctatgcctcagctggatggacaacgccgcggaggagccggttgactattacgccaccgcgctcaagagccgtgcctacagtgtggaagacttccaacctgagaacctggagtccggcggcgtcttccgtaatggcacctgcacgtcccggatcacgacgctctgagcccgggccacgcaggggctctgagcccgggccacgcaggggccctgagccaaaagagggggagaatgagaagggaaggccgggtgcgaaagggacggtatccagggcgccagggtgctgtcgggataacgtggggctaggacactgacagcctttgatggaggaacccaagaaaggcgcgcgacaatggtagaagtgagagctttgcttataaactgggaaggctttcaggctacctttttctgggtctcccactttctgttccttcctccactgcgcttgctcctctgaccctccttctattttccccaccctgcaacttctatcctttcttccgcaccgtcccgccagtgcagatc

SEQ ID NO: 1303 - DNA, 1351 bp; single-stranded, linear
  immediate source library: GENBANK
  immediate source clone: g307435
ggatccttggcctccagggtccattaaggtgagaataagatctctgggctggctggaactagcctaagactgaaaagcagccatggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctgaactgcttggggggtgggaaagaaccaagccatgctctgtctactggcaatgggctccctacccacactggcttcctgcctcccacccctcacacctggcttctagaatagaggattgctcagcatgagtccaattagagaacggtgtttgagtcagctt

SEQ ID NO: 1304 - DNA, 2118 bp; single-stranded, linear
  immediate source library: GENBANK
  immediate source clone: g308764
gcggccgcgcggctttttgacgtcagggccaagcgaggggatcgcgccagcaaccccagctctccccagagaggggccggccgaccgctggagcggagcctgacgccaggcgcccgcggagcgtgagtagggggcgcgggagccggtcagctggggcgcagcatgccctctgctcccgcgccatggagatcgccctggtgcccctggagaacggcggtgccatgaccgtcagaggaggcgatgaggcccgggcaggctgcggccaggccacagggggagagctccagtgtcccccgacggctgggctcagcgatgggcccaaggagccggcgccaaaggggcgcgcgcagagagacgcggactcgggagtgcggcccttgcctccgctgccggacccgggagtgcggcccttgcctccgctgccagaggagctgccacggcctcgacggccgcctcccgaggacgaggaggaagaaggcgatcccggcctgggcacggtggaggaccaggctctgggcacggcgtccctgcaccaccagcgcgtccacatcaacatctccgggctgcgctttgagacgcagctgggcaccctggcgcagttccccaacacactcctgggggaccccgccaagcgcctgccgtacttcgaccccctgaggaacgagtacttcttcgaccgcaaccggcccagcttcgacggtatcctctactactaccagtccgggggccgcctgcgaggggtcaacgtctccctggacgtgttcgcggacgagatacgcttctaccagctgggggacgaggccatggagcgcttccgcgaggatgagggcttcattaaagaagaggagaagcccctgccccgcaacgagttccagcgccaggtgtggcttatcttcgagtatccggagagctctgggtccgcgcgggccatcgccatcgtctcggtcttggttatcctcatctccatcatcaccttctgcttggagaccctgcctgagttcagggatgaacgtgagctgctccgccaccctccggcgccccaccagcctcccgcgcccgcccctggggccaacggcagcggggtcatggcccccgcctctggccctacggtggcaccgctcctgcccaggaccctggccgaccccttcttcatcgtggagaccacgtgcgtgatctggttcaccttcgagctgctcgtgcgcttcttcgcctgccccagcaaggcagggttctcccggaacatcatgaacatcatcgatgtggtggccatcttcccctacttcatcaccctgggcaccgaactggcagagcagcagccagggggcggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacaaccagggaacccatttctctagcatccctgacgccttctggtgggcagtggtcaccatgaccactgtgggctacggggacatgaggcccatcactgttgggggcaagatcgtgggctcgctgtgtgccatcgccggggtcctcaccattgccctgcctgtgcccgtcatcgtctccaacttcaactacttctaccaccgggaaacggatcacgaggagccggcagtccttaaggaagagcagggcactcagagccaggggccggggctggacagaggagtccagcggaaggtcagcgggagcaggggatccttctgcaaggctggggggaccctggagaatgcagacagtgcccgaaggggcagctgccccctagagaagtgtaacgtcaaggccaagagcaacgtggacttgcggaggtccctttatgccctctgcctggacaccagccgggaaacagatttgtgaaaggagattcaggcagactggtggcagtggagtagggaatgggaggcttctgaacatggatatctacattatccgcagagtatttgactcactcctctct

SEQ ID NO: 1305 - DNA, 2152 bp; single-stranded, linear
  immediate source library: GENBANK
  immediate source clone: g31192
gctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcaaaaaaaaaaaaaaaaaaaaaaaaaa

SEQ ID NO: 1306 - DNA, 2067 bp; single-stranded, linear
  immediate source library: GENBANK
  immediate source clone: g312394
atggcggacctggaggccgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagctttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacgtgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacaggaacagcaacggcctctga

SEQ ID NO: 1307 - DNA, 413 bp; single-stranded, linear
  immediate source library: GENBANK
  immediate source clone: g31654
cagacgagatgcagcgactatgtgtgtatgtgctgatctttgcactggctctggccgccttctctgaagcttcttggaagccccgctcccagcagccagatgcacccttaggtacaggggccaacagggacctggagctaccctggctggagcagcagggcccagcctctcatcatcgaaggcagctgggaccccagggtcccccacacctcgtggcagacccgtccaagaagcagggaccatggctggaggaagaagaagaagcctatggatggatggacttcggccgccgcagtgctgaggatgagaactaacaatcctagaaccaagcttcagagcctagccacctcccaccccacttcagccctgtcccctgaaaaactgatcaaaaataaactagtttccagtggatc

SEQ ID NO: 1308 - DNA, 1036 bp; single-stranded, linear
  immediate source library: GENBANK
  immediate source clone: g31741
gctttcccccacctccagggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaataccgagaactgatgggtattctctcccagggg

SEQ ID NO: 1309 - DNA, 1516 bp; single-stranded, linear
  immediate source library: GENBANK
  immediate source clone: g31912
gccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaag

SEQ ID NO: 1310 - DNA, 1434 bp; single-stranded, linear
  immediate source library: GENBANK
  immediate source clone: g32048
atgctgccgccaggcagcaacggcaccgcgtacccggggcagttcgctctataccagcagctggcgcaggggaacgccgtggggggctcggcgggggcaccgccactggggccctcacaggtggtcaccgcctgcctgctgaccctactcatcatctggaccctgctgggcaacgtgctggtgtgcgcagccatcgtgcggagccgccacctgcgcgccaacatgaccaacgtcttcatcgtgtctctggccgtgtcagaccttttcgtggcgctgctggtcatgccctggaaggcagtcgccgaggtggccggttactggccctttggagcgttctgcgacgtctgggtggccttcgacatcatgtgctccactgcctccatcctgaacctgtgcgtcatcagcgtggaccgctactgggccatctccaggcccttccgctacaagcgcaagatgactcagcgcatggccttggtcatggtcggcctggcatggaccttgtccatcctcatctccttcattccggtccagctcaactggcacagggaccaggcggcctcttggggcgggctggacctgccaaacaacctggccaactggacgccctgggaggaggacttttgggagcccgacgtgaatgcagagaactgtgactccagcctgaatcgaacctacgccatctcttcctcgctcatcagcttctacatccccgttgccatcatgatcgtgacctacacgcgcatctaccgcatcgcccaggtgcagatccgcaggatttcctccctggagagggccgcagagcacgcgcagagctgccggagcagcgcagcctgcgcgcccgacaccagcctgcgcgcttccatcaagaaggagaccaaggttctcaagaccctgtcggtgatcatgggggtcttcgtgtgttgctggctgcccttcttcatccttaactgcatggtccctttctgcagtggacaccccgaaggccctccggccggcttcccctgcgtcagtgagaccaccttcgacgtcttcgtctggttcggctgggctaactcctcactcaaccccgtcatctatgccttcaacgccgactttcagaaggtgtttgcccagctgctggggtgcagccacttctgctcccgcacgccggtggagacggtgaacatcagcaatgagctcatctcctacaaccaagacatcgtcttccacaaggaaatcgcagctgcctacatccacatgatgcccaacgccgttacccccggcaaccgggaggtggacaacgacgaggaggagggtcctttcgatcgcatgttccagatctatcagacgtccccagatggtgaccctgttgctgagtctgtctgggagctggactgcgagggggagatttctttagacaaaataacacctttcaccccgaatggattccattaa

SEQ ID NO: 1311 - DNA, 2565 bp; single-stranded, linear
  immediate source library: GENBANK
  immediate source clone: g32066
aattccgtggtaatggatgatgcagttcaaataactaaggacacatgttcaaagagcataattaactttttaaaagaagctagacttcttcagaagcttgccagtttttcaagctgatttctctcactggcaactcttcagagtgctgttcctactccaccctcccctggtgataagcatggattcctggttcattcttgttctgctcggcagtggtctgatatgtgtcagtgccaacaatgctaccacagttgcaccttctgtaggaatcacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctggccggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggc

SEQ ID NO: 1312 - DNA, 1854 bp; single-stranded, linear
  immediate source library: GENBANK
  immediate source clone: g32085
ctgcagttactggtgaggcaggtaagagagaaaccaacacactttatgtttcagaagtaaatagatgagtattttagaaaggatggaatattgttacatgttaaagataaatgaagagaaaaaagataaagttaagtcatttctgattatagagattctaattatagatatttgtggtatagagatgattattataatgtcagttaaataattttcgcagaacactcagcagaccaagtgtcacagaaatatctccattttaaaattcagattttaaaggatactgttgtttttccattaaagatactggagacagagcatgatgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctatgtatttgtttctcagcaacttgtccttctctgacctctgcttctcttccgtgaccattcccaagttgttacagaacatgcagaaccaggacccatccatcccctatgcggactgcctgacccaaatgtacttcttcctgttatttggagacctggagagcttcctccttgtggccatggcctatgaccgctatgtggccatctgcttccccctgcactacaccgccatcatgagccccatgctctgtctcgccctggtggcgctgtcctgggtgctgaccaccttccatgccatgttacacactttactcatggccaggttgtgtttttgtgcagacaatgtgatcccccactttttctgtgatatgtctgctctgctgaagctggccttctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctgtctgtggtgtcactgttctatggaaccgttattggtctctacttatgctcatcagctaatagttctactctaaaggacactgtcatggctatgatgtacactgtggtgacccccatgctgaaccccttcatctacagcctgaggaacagagacatgaagggagccctgagcagagtcattcatcagaagaaaactttcttctctctctgatgataacacttggagctattacatagtttatccagtaaaatattgatattaatattggaatattattctaaattatttcctcaccatccttttgttgaaatggcatcgtacataatttttcaatatgtagtggagatgaagcatagctgagtagttgaactagggaagagggtcttggtgacctggctaagacctcctgtttgtcttcccaaggtgatcttggaaaaatgtagtttaagaacaactgttttaaatggtcttcatgccccacattcttaaattatcacaggattttgttatgttactcagaattttgctttgattgtagaatcatttttgtttaattaaaaaaatttttaaattttttgtttatttttattttctatttcgcacagggtctcactctgttgcccaggctggagtgcagtggcacaatcgtggctcactgtaacctcaaccttctggactcaagggattctcctgcctcagcctcccaagtagctagactacaggcatgcaccactacgcccagctaattttaagatttttttgtagagatgaggtctccctaagtttctcaggctggtctt

SEQ ID NO: 1313 - DNA, 1438 bp; single-stranded, linear
  immediate source library: GENBANK
  immediate source clone: g32092
cctgaaaatgtgcactcatctctgaagagtaggaaagaaataagaggagaaaagagaagccattccagatgtcagggaggaagagtagatatgaagtaggagcatgtatggttatacagtgaaaaagtgagactatatgattctatgatgcatggaaaattataacagatggtcacagagtaaaaatattttaagtaaagataagtaaacccagggattaacttaatccactaggaaatacatcaccagatttgtaactgagaactattgaacttcaatcaatttcagaaatgtgcttctactgctttactgagactatgtgacttttatgcttttatgtttcagatttgggaaccaatccatgaaaagagagaactttactctcatcactgactttgttttccaaggtttctctagcttccatgagcagcagatcaccctttttggcgtgttccttgcactatacatcttaaccttagcaggcaatatcatcattgtgaccatcatccgaattgatcttcatcttcacacacccatgtacttcttcctgagcatgctgtccacttcagagactgtatatacattggtcattctcccaagaatgctctccagcctcgtaggtatgagccagcccatgtcattggcagggtgtgccacacagatgttcttttttgtaacctttggcatcactaactgcttcctgctcacagcaatgggatatgaccgctatgtggccatctgcaaccccctgagatacatggttattatgaacaagaggctgcgtatccaacttgtcctgggggcctgcagcattgggctgattgtagcaataacgcaagtgacatctgtattcaggttacccttctgtgctagaaaggtgccccacttcttctgtgacatccgccctgtgatgaagctctcctgcattgacaccactgtcaatgaaatcctgactttgattatcagtgtgctggtgcttgttgtacctatgggtctggttttcatttcttatgttctcattatctctacaatcctcaagattgcttcagttgagggccggaagaaggcttttgccacctgtgcatcccacctcactgtggtcattgtccactacagctgtgcctccattgcctacctcaagcccaagtcagagaacaccagagaacatgaccagctgatctcggtgacctacactgtcatcactcccctactgaaccctgtggtatacaccctgagaaataaagaggtcaaagatgctctgtgcagggctgttggtgggaagttttcctgaccatgtaggaagagttctcctgaggctgtcaacatccacactaggcaggaatatgaggtgtaaactcacaaacacttggctcctagagacctgccccttaaataagaggcaaaagaggaatagcagtttcatacaactgggagtctg

SEQ ID NO: 1314 - DNA, 1913 bp; single-stranded, linear
  immediate source library: GENBANK
  immediate source clone: g32323
tcttttaacgtatgtaatgcaaagaacaaacaaataaaggcagaaatttttctaactctgtctcttctctctttcccccagactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgacacatca

SEQ ID NO: 1315 - DNA, 594 bp; single-stranded, linear
  immediate source library: GENBANK
  immediate source clone: g337751
cccaccctgggacaggctctcaccctcctctcctgcagctccagctttgtgctctgcctctgaggagaccatggcccagcatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgaaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctgggggccaatgggactgtgcaggagacagcgg

SEQ ID NO: 1316 - DNA, 1405 bp; single-stranded, linear
  immediate source library: GENBANK
  immediate source clone: g337933
ccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtcgatgaccttgtggagtgcgtcaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcag

SEQ ID NO: 1317 - DNA, 2733 bp; single-stranded, linear
  immediate source library: GENBANK
  immediate source clone: g338027
gaattcgggagcgtcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactgtctgggaaaaaaagaataaaaagtagtgtgagagcagaaaacgtgattgaaacacgaccaatctttcttcagtgccaaagggtggaaaagaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatgtgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggaattc

SEQ ID NO: 1318 - DNA, 1416 bp; single-stranded, linear
  immediate source library: GENBANK
  immediate source clone: g338056
tagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccacagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctg

SEQ ID NO: 1319 - DNA, 3597 bp; single-stranded, linear
  immediate source library: GENBANK
  immediate source clone: g33833
ggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctc

SEQ ID NO: 1320 - DNA, 1658 bp; single-stranded, linear
  immediate source library: GENBANK
  immediate source clone: g338477
cggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaatcctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtgggatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgacagatttgcaggcttaagcagaacaagggaagattgatatttttggatatgctatagcagctttctcctatgaaataaaactgatgatgtttggaag

SEQ ID NO: 1321 - DNA, 1413 bp; single-stranded, linear
  immediate source library: GENBANK
  immediate source clone: g338498
atgggagggggcagcacagagaaagccattctctgctgtgaccgagctgtttttccttcccccaggcaaatgactgctgaccaccctcccctcagccatggacatgcttcatccatcatcggtgtccacgacctcagaacctgagaatgcctcctcggcctggcccccagatgccaccctgggcaacgtgtcggcgggcccaagcccggcagggctggccgtcagtggcgttctgatccccctggtctacctggtggtgtgcgtggtgggcctgctgggtaactcgctggtcatctatgtggtcctgcggcacacggccagcccttcagtcaccaacgtctacatcctcaacctggcgctggccgacgagctcttcatgctggggctgcccttcctggccgcccagaacgccctgtcctactggcccttcggctccctcatgtgccgcctggtcatggcggtggatggcatcaaccagttcaccagcatattctgcctgactgtcatgagcgtggaccgctacctggccgtggtacatcccacccgctcggcccgctggcgcacagctccggtggcccgcacggtcagcgcggctgtgtgggtggcctcagccgtggtggtgctgcccgtggtggtcttctcgggagtgccccgcggcatgagcacctgccacatgcagtggcccgagccggcggcggcctggcgagccggcttcatcatctacacggccgcactgggcttcttcgggccgctgctggtcatctgcctctgctacctgctcatcgtggtgaaggtgcgctcagctgggcgccgggtgtgggcaccctcgtgccagcggcgccggcgctccgaacgcagggtcacgcgcatggtggtggccgtggtggcgctcttcgtgctctgctggatgcccttctacgtgctcaacatcgtcaacgtggtgtgcccactgcccgaggagcctgccttctttgggctctacttcctggtggtggcgctgccctatgccaacagctgtgccaaccccatcctttatggcttcctctcctaccgcttcaagcagggcttccgcagggtcctgctgcggccctcccgccgtgtgcgcagccaggagcccactgtggggcccccggagaagactgaggaggaggatgaggaggaggaggatggggaggagagcagggaggggggcaaggggaaggagatgaacggccgggtcagccagatcacgcagcctggcaccagcgggcaggagcggccgcccagcagagtggccagcaaggagcagcagctcctaccccaagaggcttccactggggagaagtccagcacgatgcgcatcagctacctgtaggggcctggggaaagccaggatggcccgaggaagaggcagaagccgtgggtgtgcctagg

SEQ ID NO: 1322 - DNA, 1172 bp; single-stranded, linear
  immediate source library: GENBANK
  immediate source clone: g33917
gagacattcctcaattgcttagacatattctgagcctacagcagaggaacctccagtctcagcaccatgaatcaaactgcgattctgatttgctgccttatctttctgactctaagtggcattcaaggagtacctctctctagaaccgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaatgtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtataagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaataaaaatgaggtactctcctggaaatattaagaaagactatctaaatgttgaaagatcaaaaggttaataaagtaattataact

SEQ ID NO: 1323 - DNA, 1866 bp; single-stranded, linear
  immediate source library: GENBANK
  immediate source clone: g339195
ccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcctggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctcctcgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctctgagctggttgtggcacagtagctggggagacctcagcagggctgctcagtgcctgcctctgacaaaattaaagcattgatggcctgtggacctgcaaaaaa

SEQ ID NO: 1324 - DNA, 3510 bp; single-stranded, linear
  immediate source library: GENBANK
  immediate source clone: g33941
ctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgcggagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattctcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaacgaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacagaaatgaaagctactcatagcgggggcctaaaaaaaaaaaatgcttcacagtacccaaactgctttttccaactcagaaattcaatttggatttaaaagcctgctcaatccctgaggactgatttcagagtgactacacaca

SEQ ID NO: 1325 - DNA, 1160 bp; single-stranded, linear
  immediate source library: GENBANK
  immediate source clone: g339420
cctccgacagcctctccacaggtaccatgaaggtctccgcggcacgcctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctgaccacgacgagcagcagttacaaaaaccttccccaggctggacgtggtggctcagccttgtaatcccagcactttgggaggccaaggtgggtggatcacttgaggtcaggagttcgagacagcctggccaacatgatgaaaccccatgtgtactaaaaatacaaaaaattagccgggcgtggtagcgggcgcctgtagtcccagctactcgggaggctgaggcaggagaatggcgtgaacccgggagcggagcttgcagtgagccgagatcgcgccactgcactccagcctgggcgacagagcgagactccgtctcaaaaaaaaaaaaaaaaaaaaaaaaaatacaaaaattagccgcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgcaagggctctgtgacaaggaaggaagtcagcatgcctctagaggcaaggaagggaggaacactgcactcttaagcttccgccgtctcaacccctcacaggagcttactggcaaacatgaaaaatcgggg

SEQ ID NO: 1326 - DNA, 4080 bp; single-stranded, linear
  immediate source library: GENBANK
  immediate source clone: g33950
gcgctgcccgcctcgtccccaccccccaaccccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctgtgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggcgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggt

SEQ ID NO: 1327 - DNA, 2153 bp; single-stranded, linear
  immediate source library: GENBANK
  immediate source clone: g339559
ctggtatatttgtgcctgctggaggtggaattaacagtaagaaggagaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatataggaatgcataggtcatctgatcaaataatattagccgtcttctgctacatcaatgcagcaaaaactcttaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcagctactgggaaactgtacctcctagaaccttaggtttttttttttttaagaggacaagaaggactaaaaatatcaacttttgcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggagtactcagtaagggcatccttggcagaagagaccagaggggcaagaaagggatacccagcctctcccaatgggtatcctcgtcgcatacagttatctcggacgactcctctgaccacccagagtcctcctctagccagcctccatgataccaactttctgaatgatgctgacatggtcatgagctttgtcaacttagttgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaatagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggagattataacacaagtgagcaaaaacaagcctgtaagaagcacgaactctatgtgagcttccgggatctgggatggcaggactggattatagcaccagaaggatacgctgcattttattgtgatggagaatgttcttttccacttaacgcccatatgaatgccaccaaccacgctatagttcagactctggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacagaaaaaaaaa

SEQ ID NO: 1328 - DNA, 3472 bp; single-stranded, linear
  immediate source library: GENBANK
  immediate source clone: g339676
gcgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctcgtcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctcgtgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctc

SEQ ID NO: 1329 - DNA, 520 bp; single-stranded, linear
  immediate source library: GENBANK
  immediate source clone: g339728
accaggctcatcaaagctgctccaggaaggcccaagccagaccagaagacatgcagatcatcaccacagccctggtgtgcttgctgctagctgggatgtggccggaagatgtggacagcaagagcatgcaggtacccttctccagatgttgcttctcatttgcggagcaagagattcccctgagggcaatcctgtgttacagaaataccagctccatctgctccaatgagggcttaatattcaagctgaagagaggcaaagaggcctgcgccttggacacagttggatgggttcagaggcacagaaaaatgctgaggcactgcccgtcaaaaagaaaatgagcagatttctttccattgtgggctctggaaaccacatggcttcacctgtccccgaaactaccagccctacaccattccttctgccctgcttttgctaggtcacagaggatctgcttggtcttgataagctatgttgttgcactttaaacatttaaattatacaatcatcaacccccaac

SEQ ID NO: 1330 - DNA, 3089 bp; single-stranded, linear
  immediate source library: GENBANK
  immediate source clone: g33984
gaaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggaccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatg

SEQ ID NO: 1331 - DNA, 1839 bp; single-stranded, linear
  immediate source library: GENBANK
  immediate source clone: g339991
gaattcgcgctcaactcagctcactgagagtctctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgactgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagacctttgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactaaacggaattc

SEQ ID NO: 1332 - DNA, 1806 bp; single-stranded, linear
  immediate source library: GENBANK
  immediate source clone: g340198
gccgctcgctcggctccgctccctggctcggctccctgcctccgcgtcgcagcccccgccgtagccgcctccgagcccgccgccacatcctctgagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctc

SEQ ID NO: 1333 - DNA, 1404 bp; single-stranded, linear
  immediate source library: GENBANK
  immediate source clone: g340200
gctgcagctgcagcagctggagggcgaagtgaaggagacaccgttccgcccgcggcctcgccatggcgacccacggacagacttgcgcgcgtccaatgtgtattcctccatcatatgctgaccttggcaaagttgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacat

SEQ ID NO: 1334 - DNA, 595 bp; single-stranded, linear
  immediate source library: GENBANK
  immediate source clone: g340298
ggtcgactacctgtgtgcacaggatgcctgacaccatgctgcccgcctgcttcctcggcctactggccttctcctccgcgtgctacttccagaactgcccgaggggcggcaagagggccatgtccgacctggagctgagacagtgcctcccctgcggccccgggggcaaaggccgctgcttcgggcccagcatctgctgcgcggacgagctgggctgcttcgtgggcacggctgaggcgctgcgctgccaggaggagaactacctgccgtcgccctgccagtccggccagaaggcgtgcgggagcgggggccgctgcgccgccttcggcgtttgctgcaacgacgagagctgcgtgaccgagcccgagtgccgcgaggtctttcaccgccgcgcccgcgccagcgaccggagcaacgccacgcagctggacgggccggccggggccttgctgctgcggctggtgcagctggccggggcgcccgagcccttcgagcccgcccagcccgacgcctactgagtccccgtgttcgtcccaccggcgcgctcttcgcgcccgcccctgcagcacggacaataaacctccgccaatgcaaa

SEQ ID NO: 1335 - DNA, 1086 bp; single-stranded, linear
  immediate source library: GENBANK
  immediate source clone: g34030
ctaaaggtcccctccccggagcggagcgcacctagggtccctcttccgtccccccagcccagctacccgttcagaccagcagcctcggggggcaccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgttttttcttctactctgtggccccaaattttataaagtga

SEQ ID NO: 1336 - DNA, 1629 bp; single-stranded, linear
  immediate source library: GENBANK
  immediate source clone: g340443
acaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactga

SEQ ID NO: 1337 - DNA, 2351 bp; single-stranded, linear
  immediate source library: GENBANK
  immediate source clone: g340445
gcgcggcggcggacctcgggttgccctcggtccgagtgatccctggtcgcttccttagccctcccgccttcggcattggggtccccgcgtcccccgggcctccaggcgggaaagcgcgggggctttgcggggccttgagcgcctggtgtgggaggtggtcgagcccagccaccctcccccgcggcggcgcgaggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaactt

SEQ ID NO: 1338 - DNA, 1032 bp; single-stranded, linear
  immediate source library: GENBANK
  immediate source clone: g34271
tgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccaggtttgtggaacagtgagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttaatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttct

SEQ ID NO: 1339 - DNA, 1386 bp; single-stranded, linear
  immediate source library: GENBANK
  immediate source clone: g34450
atgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatag

SEQ ID NO: 1340 - DNA, 1560 bp; single-stranded, linear
  immediate source library: GENBANK
  immediate source clone: g34518
ctccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagatatacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaaaaaaaaccgg

SEQ ID NO: 1341 - DNA, 1081 bp; single-stranded, linear
  immediate source library: GENBANK
  immediate source clone: g34658
ctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtgagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaat

SEQ ID NO: 1342 - DNA, 4080 bp; single-stranded, linear
  immediate source library: GENBANK
  immediate source clone: g34764
atcacattaggtgcagccggcaggccatcccaactcgggccgggagcgcacgcgtcactggggccgtcagtcgccgtgcaacttccccggggggagtcaactttaggttcgcctgcggactcggtgcagtggaagccgctgaacatcccgaggaactggcacgctgggggctctgggcttgtggccggtagaggattcccgctcatttgcagtggctcagaggagggtggacccagcagatccgtccgtggagtctccaggagtggagccccgggcgcccctacaccctccgacacgccggatccggcccagccgcgccaagccgtaaagggctcgaaggccggggcgcaccgctgccgccagggtcatggagggcgcgctcgcagccaactggagcgccgaggcagccaacgccagcgccgcgccgccgggggccgagggcaaccgcaccgccggacccccgcggcgcaacgaggccctggcgcgcgtggaggtggcggtgctgtgtctcatcctgctcctggcgctgagcgggaacgcgtgtgtgctgctggcgctgcgcaccacacgccagaagcactcgcgcctcttcttcttcatgaagcacctaagcatcgccgacctggtggtggcagtgtttcaggtgctgccgcagttgctgtgggacatcaccttccgcttctacgggcccgacctgctgtgccgcctggtcaagtacttgcaggtggtgggcatgttcgcctccacctacctgctgctgctcatgtccctggaccgctgcctggccatctgccagccgctgcgctcgctgcgccgccgcaccgaccgcctggcagtgctcgccacgtggctcggctgcctggtggccagcgcgccgcaggtgcacatcttctctctgcgcgaggtggctgacggcgtcttcgactgctgggccgtcttcatccagccctggggacccaaggcctacatcacatggatcacgctagctgtctacatcgtgccggtcatcgtgctcgctacctgctacggccttatcagcttcaagatctggcagaacttgcggctcaagaccgctgcagcggcggcggccgaggcgccagagggcgcggcggctggcgatggggggcgcgtggccctggcgcgtgtcagcagcgtcaagctcatctccaaggccaagatccgcacggtcaagatgactttcatcatcgtgctggccttcatcgtgtgctggacgcctttcttcttcgtgcagatgtggagcgtctgggatgccaacgcgcccaaggaagcctcggccttcatcatcgtcatgctcctggccagcctcaacagctgctgcaacccctggatctacatgctgttcacgggccacctcttccacgaactcgtgcagcgcttcctgtgctgctccgccagctacctgaagggcagacgcctgggagagacgagtgccagcaaaaagagcaactcgtcctcctttgtcctgagccatcgcagctccagccagaggagctgctcccagccatccacggcgtgacccaccagccagggccagggctgcagcctgaggctcaggctgtgctggcataagtgctctgctcctaggtgatggcgtatgtttgtgtataaggtacctatcagtttgtatccctcccctccttggggtggcttcagtggggtggagagtggcctccatgatggaagatgataggggactcagccatcagacaacaccctggcctcctacacgtacttctaccaccctgaacccactgctgccctgggcagtgagtggcttgttttttctcctggacttgtaatttcactccagtatatttttacttcttcattctgggatattgtgaaaagcggtaaatataggattggtgaccaattgggtcaggaagtccagtgttctggacttggggtaagcagtggggttgggacctcagatgggaagggtggtgctaagatcctcctgacctcaaagtgtatttgcctttaagcgaacaaatgctggggtccttggggaccagcttgtcagagggtagccctaagagaaggggattaccttgtaagaccatctggcgcagtggacctattagaacttgggttaaaaatgtttaagaagctaatgtttaagaagcatttgggaaagaaaaagaaataaatgtatccagataggaaaagaagaagtaaaactatttgcagatgacacagttttgtatatagaaaatcctaaggaactcacacacacacacacacacacacacgcacacagctattagaactaataagcaagttccgcaaggtttcaagatacaagatcaatatacaaaaatgaattgtatttctttatactagcaacaaacaatatgaaaacgaagttaaataattccatttataataccatcagaaagaataaaataggaatcaacttaacaaaacaagtgcaagactgaaaactacaaaattggaaagaaattaaagaaggcttaaataaatggaaagacatcctgtgttcatggatcagacttagtattgttaagatggcaatactatcctaactgacatgcagattcagtgcaatccttatgaaaatcatagctggcttttttacagaaattgataagctagtcccaaaattcataaagaaatgcaagggacccagatatccaaataagccttgaaaaagaacaaagttggtggattcacacttcctgatttcataatttacgataaaggtaatcagctcagtgtgttactggtttaaggatagacatacggagcagaataaagagtacagatatgaacacttatacttacggtcaattgatttttgacaaggttcccaagacaattcaatagagaaaggagagtcttttcaacaaatggcaccgagacaatgatatgcaagtgcaaaagaatgaggttggacctttactcacactatgtgcaaaaatcaactcaaaacgcatccaagatctaaatataagagctgaaactataaaatcttagaaagaaacataggcatagatctttgtaaccttgaattaggcagtggtttcttagatatgataccaaagacacaagcaaccaatggaaaaataggtaaattggacttaatcaagatttgaagcttttgtgattgaaaagaccctatcaagaaggtgaaaagataacctgcagaatgggagaaaatatttgcgagtcatatatatgataaggggcttgtatctggaatatataaataactcttataacacaacaataaggagaaaaataaatcaatttaaaaaatgggctaacggtttgaatagacatttctccaaagaagatatgcaaatggctactaagcacatgaaaaatactcaacattattattcattagggaaatgcaagtcaaaatcacaatgagattccagtttacaatcactaggatggctacaataaaaagatggacaagaacgagtgtcggtgaggatgtagagaaactggtagaaatttaaattgttggtgggaatgtaaatggtgcacctgctttgaaaaacagtttggcagtacctcaaaaagttaaacgtagagtgaccatatgacccaggaatgccactcctaggtatttacccaagagaaatgaaaacgtacatacacacaaaaacttgtacaccaatgttcatagcaacattatttgtaatagccaaaaagtggaaacaacccaaatgtctaccaactgatgaatgggaaataaaatgtggtctgtccacgcaatggaacattattagactctaaaaagaaatgaagtactcacacatgccacaacatggatgagccttgaaaacttgctaagtgaaagaagccaggtgcaaaagcccacatattgtctgactgcattgaaatgcaatgtctaaaatggacgaatctatatagagtgaatatagattagcgtttgccagggcctggaggctgtgagagatgaggcatgactactaagggtttggggtttctttttcgggtgatgaaaatgttcgaaattagtggtgattgtgcacgattttgagaatgtactaaaaaccaatgaac

SEQ ID NO: 1343 - DNA, 1633 bp; single-stranded, linear
  immediate source library: GENBANK
  immediate source clone: g34790
cccgcatgtggccgccctcaatggagggctctgagaacgacttttaaaacgcagagaaaaagctccattcttcccagacctcagcgcagccctggcccaggaaggcaggagacagaggccaggacggtccagaggtgtcgaaatgtcctgggaacctgagcagcagccaccagggaagaggcagggagggagctgaggaccaggcttggttgtgagaatccctgagcccaggcggttgatgccaggaggtgtctggactggctgggccatgcctgggctgacctgtccagccagggagagggtgtgagggcagatctgggggtgcccagatggaaggaggcaggcatggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggacgaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgccgcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcgctttaagtgtgctgggcagagggaggtggtgatattgtggtctggttcctgtgtgaccctgggcagttccttacctccctggtccccgtttgtcaaagaggatggactaaatgatctctgaaagtgttgaagcgcggacccttctgggcagggaggggtcctgcaaaactccaggcaggacttctcaccagcagtcgtgggaac

SEQ ID NO: 1344 - DNA, 2731 bp; single-stranded, linear
  immediate source library: GENBANK
  immediate source clone: g349268
aagaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaagcggagggcattaagaacagcctcggaaaaactcagaaaccgctcatctttttctaccaacgttgtctacaccaccccgggcactcgcgtcaacaggtacatcagccgcctcttagaagcccgccagacagagctggagatggcagacctgaacttctttaccctgaagtacaaacatgtcgaacgggagcaaaagtaccaccagcttcaggacgagtatttcaccagcgccgttgtcctcaccctcatcctggctgccttatttggccttgtctaccttctaatattcccacagagtgtggtcgtcctgctcctgctagtattctgcatctgcttcctggtggcctgtgtcctgtacctgcacatcacccgggtccagtgttttccagggtgcctgacgattcagattcgcactgtcctgtgtattttcatagtggtcttaatctactcagtagcccaaggttgtgtggtgggctgcctgccttgggcctggagctccaagcccaacagttccctggtggtcctttcgtctgggggccagcgcacagccctgcccaccctgccctgcgagtctacacaccatgccctgctctgctgcctggtgggcaccctcccgctagccatatttttccgggtgtcctccttgccaaaaatgatcctgctctccgggctcaccacgtcctacatcctcgttctggagctcagcggatacaccaggactgggggtggtgccgtctccgggcgcagctacgagccgattgtggccatcctgctcttctcctgtgcgctggccctgcatgccaggcaggtggacatcaggctgaggctggactacctctgggccgcacaggcagaggaggagcgagaggacatggagaaggtgaagctggacaacaggcgcatcctcttcaacctcctgccggcccacgtcgcccagcacttcctcatgtccaaccctcggaacatggacctctactaccagtcctactcccaggtgggcgtcatgtttgcctccatccccaacttcaatgacttctacatcgagctggacggcaacaacatgggggtggagtgtctgcggcttctcaacgagatcatcgccgactttgacgagctcatggaaaaagacttttacaaggacatagagaagatcaagaccatcgggagcacctacatggccgctgtggggctagcgcccacctcggggaccaaggctaagaagtccatctcctcccacctgagcacgctggcggactttgccattgagatgtttgacgttctggatgaaatcaactaccagtcttacaacgactttgtcctccgagttggcatcaatgttggccctgtggtggctggagtgattggcgctcgcaggccccagtacgacatctggggaaacacagtcaacgtggccagtcggatggatagcacaggggtccagggcagaatccaggtgactgaggaagtccaccggctgctgagaaggtgcccctaccactttgtgtgccgaggcaaagtcagtgtcaagggcaaaggcgagatgttgacatactttctagaaggcaggactgatggaaacggctcccaaatcaggtccctgggcttggatcggaaaatgtgtccatttgggagagctggccttcagggcagacgtccccccgtgtgccccatgcctggcgtctcagtcagggctgggctccctccacactccccaggccagtacctgccctctgcagcagctgggaaggaggcttagtggagcccacgtgggcctctggggtgcacatggggtgggaatgctccgggggtgacacaggccacggtggctccagccaggaccagccagaccagcagagcagggagccacttgccagggtggaggaggagcattgtccaggcatggcctgtggcccgagggccaaccaccgagcaggtcacagcacagcagtgactcggtgaggggag

SEQ ID NO: 1345 - DNA, 1767 bp; single-stranded, linear
  immediate source library: GENBANK
  immediate source clone: g349448
tccttctgattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactactctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgagaatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctatcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcctgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcctttgtcctttctctctaattcagtgttttggaggcctgacttggggacaacgtattattgatattattgtctgttttccttcttcccaatagaagaataagtcatggagcctgaagggtgcctagttgacttactgacaaaaggctctagttgggctgaacatgtgtgtggtggtgactcatttccatgccattgtggaattgagcagagaacctgctctcggaggatgcctagaagatgttgggaacagaagaaataaactgagtttaagggggacttaaactgctgaattcacctgtggatgtttttgagtaaataaaagctaatagcg

SEQ ID NO: 1346 - DNA, 4080 bp; single-stranded, linear
  immediate source library: GENBANK
  immediate source clone: g35020
tcaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcgcgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaagtgctggtgaccgccgtgtacctggcgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctgacggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcgtgcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactaggctgtgcgccccggaacgtgtccaggaggagcctggccatgggtccttgcccccgacagacagagcagcccccacccgggagccttgatgggggtcaggcagaggccagcctgcactggagtctgaggcctgggacccccccctcccaccccctaacccatgtttctcattagtgtctcccgggcctgtccccaactcctccccacccctcccccatctcctctttgaaagccagaacaagagagcgctcctctcccagataggaaaagggcctctaacaaggagaaattagtgtgcggcaaaaggcagttttctttgttctcagactaatggatggttccagagaaggaaatgaaatgtgctgggtggggccgggcctccggcggcccggctgctgttcccatgtccacatctctgaggcctgcaccccctctgtctagctcggggagtccagccccagtcccgcaggctccgtggctttgggcctcacgtgcagaccctgccatgcagacccatgcccccctcccccaggcagctccaagaaagctccctgactcgccccttcaggcctggcaagctgggggcccatcgccgtggggagtccctcccaccaccctcgccgcaggcagctgcagcccccagaggggaccacaagcccaaaaaggacaaaaatgggctggcctggaatggcccagaccccagcctcccctcctccctcccatcctcacccaggccaaggcccaggggctctgccaggacaccacatgggagggggctcaggcctcagcctcaagatcttcagctgtggcctctcgggctcggcagaagggacgccggatcaggggcctggtctccagcacctgcccgagtggccgtggccaggatggggtgcgcattccgtgtgctttgcttgtagctgtgcaggctgaggtctggagccaggcccagagctggcttcagggtggggccttgagaaggggaatgtgggacaggggcgatggtgcctggtctctgagtaagatgccaggtcccaggaactcaggcttcaggtgagaaggagcggtgtgtccaggcaccgctggccggcagccctgggctgaggcacagactcatttgtcaccttctggcggcggcagccctggccccggcctccaagcagttgaaaaagctggcgcctccttggtctctaggatccaggctccacagagcacatgactagccaggcccctggcttaagaaggtcgcctaagcctaagagaagacagtcccaggagaagctggccgggaccagccaggagctgggagccacaggaagcaaaagtcagccttttcttcaagggatttccctgtctcagagcagcctttgccccagggaaatgggctctgggctggctgcctgcaccggccatgtcgacccaggacccggacacctggtcttgggctgtgttcagccactttgccttctctggactcagtttccccgtctgagaaatgagagtcgaatgctacagtatctgcagtcgcttggatctggctgttgagttgacgggttccttgaaccccacaaaatccctctccaaccacaggacccttcggctcaccaagaacggggcccaggggagtcaggcctattcgctgcacttcctgccaaactttgcccccacaagcctggtcatcagccaggcagccctcccagtgcccaagggccaccaaccccagggaaacagggccagcacagaggggccttcctcccccacagagctcccatgacatagtctgctctgggcggaagagctttgctgccagccagggatgtccagaggtcggtgcagcccctatccctgctcaggagtgggctcagagtctagcaaatgctaaggcccctcaggctgggctctgaacgaggacctggactcagagccagacagggcagcctcagacccttctctggggctcctggaccttgggccataatttctgagcctcggtttccccatctaaggaacagatgtggtcgttccgccctctcagctggatgagactgtcctggaggatccaccccggaacagacagaacggtgtctctcaggatggtgctctgagagagggcagagtggatgccccactgccctagaccctcggtagacgtggggtctctggggcggggtctgtggctgtgactgaagtcggctttcccgttgatgtcttgatgctcctatctgtgcacttaccgtaggtagggacacgtgtccatgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactcccaccatctgcaggtggtgaa

SEQ ID NO: 1347 - DNA, 1223 bp; single-stranded, linear
  immediate source library: GENBANK
  immediate source clone: g35060
tgcagagatgagtaaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaattcttccccgaatacaagaacgcagaaagcacgtcattgtggccattgtcctgaggagtggattacatattccaacagttgttattacattggtaaggaaagaagaacttgggaagagagtttgctggcctgtacttcgaagaactccagtctgctttctatagataatgaagaagaaataaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttacagtgcatcagatacattttatatttcttaaaatagaaatattatgattgcataaatctgaaaatgaattatgttatttgctctaatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtaatggtgatggttgtaactttgcgaatatactaaacatcattgatttttaatcattttaagtgcatgaaatgtatgctttgtacatgacacttcaataaagctatccagaaaaaaaaaaaa

SEQ ID NO: 1348 - DNA, 3171 bp; single-stranded, linear
  immediate source library: GENBANK
  immediate source clone: g35322
gcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccacgtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaaaggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctaggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaa

SEQ ID NO: 1349 - DNA, 2824 bp; single-stranded, linear
  immediate source library: GENBANK
  immediate source clone: g36060
gcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccagacccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtagcagctgcctccaggatgagttacttgaaatttgccttgagtgtgttacctcctttccaagctcctcgtgataatgcagacttcctggagtacaaacacaggatttgtaattcctactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgt

SEQ ID NO: 1350 - DNA, 3016 bp; single-stranded, linear
  immediate source library: GENBANK
  immediate source clone: g36430
gaattcgggtgagccagctccgggagaacagcatgtacaccagcctcagtgttacagagtgtgggtacatcaaggtgaatggtgagcagaaactataacctgttagtccttctacacctcatctgctacaagttctggcttagacatggatattctttgtgaagaaaatacttctttgagctcaactacgaactccctaatgcaattaaatgatgacaccaggctctacagtaatgactttaactctggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatgggtaccggtggcctctgccgagcaagctttgtgcagtctggatttacctggacgtgctcttctccacggcctccatcatgcacctctgcgccatctcgctggaccgctacgtcgccatccagaatcccatccaccacagccgcttcaactccagaactaaggcatttctgaaaatcattgctgtttggaccatatcagtaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgccgtaaataaaaatagctataaatagtgaaaattttattgaatataatggcctcttaaaaattatctttaaaacttactatggtatatattttgaaaggagaaaaaaaaaaagccactaaggtcagtgttataaaatctgtattgctaagataattaaatgaaatacttgacaacatttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcaccccgaattc

SEQ ID NO: 1351 - DNA, 930 bp; single-stranded, linear
  immediate source library: GENBANK
  immediate source clone: g36651
atgagacgcgcggcgctctggctctggctctgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaagctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggtgcctaccagaaacccaccaagcaggaggagttctacgcc

SEQ ID NO: 1352 - DNA, 4080 bp; single-stranded, linear
  immediate source library: GENBANK
  immediate source clone: g37432
ggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggttcgcttactttgagtgatcctccaacttcatttgatgctaaataggagataccaggttgaaagacctctccaaatgagatctaagcctttccataaggaatgtagcaggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccatttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatc

SEQ ID NO: 1353 - DNA, 4080 bp; single-stranded, linear
  immediate source library: GENBANK
  immediate source clone: g37503
gacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcattcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatagcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccgcgtgcagccccacaatcttgctgacgtcttgactgtgaaccgggactcaccggccgtcggacctactactttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcacgactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttg

SEQ ID NO: 1354 - DNA, 1433 bp; single-stranded, linear
  immediate source library: GENBANK
  immediate source clone: g37642
ggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttaccccctttcc

SEQ ID NO: 1355 - DNA, 1012 bp; single-stranded, linear
  immediate source library: GENBANK
  immediate source clone: g38014
catgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtgcaaagccttcagtcgtttcagttacttaaaaactcatgaaagactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacactgaaagaactcacatgagagaagccctatgaatgtaaggaatgtgggaaagccttcagttctctcagttcctttaatagacataaaaggacacactggaagatattctataagtgtatgaatgtgggaaagcattcattggttttatcacattcagatacttgaaagaaataaatcctgtgaatgtaaacgtggtaaagccttaagaagtttccaggctgggcgcagcggctcacacctgtaatcccagcactttgagaggccgaggagggcagatcacgaggccaggagatcgagaccagcctggctaacatgggaaaccctgtctctactaaaaatacgg

SEQ ID NO: 1356 - DNA, 1270 bp; single-stranded, linear
  immediate source library: GENBANK
  immediate source clone: g396704
gcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctaaaaaaaaa

SEQ ID NO: 1357 - DNA, 2988 bp; single-stranded, linear
  immediate source library: GENBANK
  immediate source clone: g400451
catcacctttttttaagtagtaagaataaagccactgtatgattctcttaatagctatacattaatcctgtttttagtgctgactgggccagccttccgggaactggagtctgtctctttcagtgcttttttgttttttgttggttttttcgagacggggtcgatcacggctcaccacagccttaacctccagggctccagcaatcctcccacctcagcctcctgagtagctgggaccacaggtgtgtgccaccatctccagcagtttgtttatttattttttctttttttttttttggtagaaatgggcttttcgcccatgttgcccaagctggtcttgcacttctgggctgaagcaatcctctcgccttggcctcccagagccttgggattacagaatcatgggtgagagctggcatggcccctagaggtcatttggggtccagctgcctcaccgtatcaatgaggaaactgaggcccagaaaagaaaagcatttttgcccagagtccctcagaaaaaaacagaccacatctgatccttggccctgagtccagagtgggaggcaccgtgacaacaatgcgcagagcagggaatgcagggagccatggatagtgctggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggcatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcagcatctttctgggcaggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccccttttattttattacctttcactctctggctgctgggtctgccgtcggtcctgctgctaacctggcagcagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaag

SEQ ID NO: 1358 - DNA, 2616 bp; single-stranded, linear
  immediate source library: GENBANK
  immediate source clone: g405081
ttccgcaggtggcagcgatggcccagtcctgaactccccgccatggccggcgcccccggcccgctgcgccttgccgtgctgctgctcgggatggtgggcagggccggcccccgcccccagggtgccactgtgtccctctgggagacggtgcagaaatggcgagaataccgacgccagtgccagcgctccctgactgaggatccacctcctgccacagacttgttctgcaaccggaccttcgatgaatacgcctgctggccagatggggagccaggctcgttcgtgaatgtcagctgcccctggtacctgccctgggccagcagtgtgccgcagggccacgtgtaccggttctgcacagctgaaggcctctggctgcagaaggacaactccagcctgccctggagggacttgtcggagtgcgaggagtccaagcgaggggagagaagctggggggaggagcagctcctgttcctctacatcatctacacggtggcgtacgcactctccttctctgctctggttatcgcctctgcgatcctcctcggcttcagacacctgcactgcaccaggaactacatccacctgaacctgtttgcatccttcatcctgcgagcattgtccgtcttcatcaaggacgcagccctgaagtggatgtatagcacagccgcccagcagcaccagtgggatgggctcctctcctaccaggactctctgagctgccgcctggtgtttctgctcatgcagtactgtgtggcggccaattactactggctcttggtggagggcgtgtacctgtacacactgctggccttctcggtcttctctgagcaatggatcttcaggctctacgtgagcataggctggggtgttcccctgctgtttgttgtcccctggggcattgtcaagatcctctatgaggacgagggctgctggaccaggaactccaacatgaactactggctcattatccggctgcccattctctttgccattggggtgaacttcctcatctttgttcgggtcatctgcatcgtggtatccaaactgaaggccaatctcatgtgcaagacagacatcaaatgcagacttgccaagtccacgctgacactcatccccctgctggggactcatgaggtcatctttgcctttgtgatggacgagcacgcccgggggaccctgcgcttcatcaagctgtttacagagctctccttcacctccttccaggggctgatggtggccatcttatactgctttgtcaacaatgaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctgagactccagcgcctgccctccctggggtccttgctgcaggccgggtggcaatccaggtgggagagacactcccagggacaagggaaggaagggacacacacacacacacacacacacacacacacacacatacatcctgctttccctccccaaacccatcagacaggtaaatgggcagtgcctcctgggaccatggacacattttctcctaggagaagcagcctcctaatttgatcacagtggcgagaggagaggaaaaacgatcgctgtgaaaatgaggaggattgcttcttgtgaaaccacaggcccttggggttcccccagacagagccgcaaatcaaccccagactcaaactcaaggtcaacggcttattagtgaaactggggcttgcaagaggaggtggttctgaaagtggctcttctaacctcagccaaacacagagcgggagtgacgggagcctcctctgcttgcatcacttggggtcaccaccctcccctgtcttctctcaaagggaagctgtttgtgtgtctgggttgcttatttccctcatcttgccccctcatctcactgcccagtttctttttgagggcttgttggccactgccagcagctgtttctggaaatggctgtaggtggtgttgagaaagaatgagcattgagacacggtgctcgcttctcctccaggtatttgagttgttttggtgcctgcctctgccatgcccagagaatcagggcaggcttgccaccggggaacccagccctggggtatgagctgccaagtctattttaaagacgctcaagaatcctctggggttcatctagggacacgttaggaatgtccagactgtgggtgtaggttacctgccacttccaggacgcagagggccaagagagacattgcctccacctctcctgaatacttatctgtgaccacacgctgtctcttgagatttggatacactctctagctttaggggaccatgaagagactctcttaggaaaccaatagtccccatcagcaccatggaggcaggctccccctgcctttgaaattcccccacttgggagctgatatacttcactcacttttctttattgctgtgatagtctgtgtgcacaatgggcaattctgacttctcccatctagtggaaatgagcgaaatcatggttgtagtgatcttg

SEQ ID NO: 1359 - DNA, 1790 bp; single-stranded, linear
  immediate source library: GENBANK
  immediate source clone: g407806
caggtcctgggagaggacagaaaacaactggactcctcagcccccggcagctcccagtgcccagccacccacaacacaacccaaagccttctagacaagctcagtggaatctgaagggcccaccccatggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctgatgaggcctcttcccaatttaaacaactcaagtcagaaatcagttcactccctggaagagagagaggggtcttggcactctcttcttacttaaaccagtcccagacacctagacacggacccctttttgctgatgagtgttgggactgactcctggaagacagcctggccttgcccacctgcacacagtctgttggataggtagggccacgaggagtagccaggtaggcgagacacaaaaaggcctgggacagggtcagtacaagtcaggacaggcttcatgcctgcatcctccagagaccaccaggagccaaagcgagcctccaggcccagcaatgagggacttgggagaaatctgagaagaatgggttgttctcttgggaagtcagggtatcagatgggatggacatccaggtcttctctctgcctaattgtcaaggcctccttggctctggagctatgaaaggccccactttcaagtcacccttgccactgaggaccgaggactatgctatgatgaggattaaggtgttgacttgcctctttcagagataaatgacaagccttcaaaaaaaaaaaaaaa

SEQ ID NO: 1360 - DNA, 1335 bp; single-stranded, linear
  immediate source library: GENBANK
  immediate source clone: g408691
atgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggccaggctgcacccattggggtgaccaggcagatggagccctggaggtgggggctccatggagtggtgccccatttcaggttcgaaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctga

SEQ ID NO: 1361 - DNA, 1376 bp; single-stranded, linear
  immediate source library: GENBANK
  immediate source clone: g410208
gggggcggcagggctgagcggccggtgatggggaccccacatcccaggcagtgccggcacccctggcgcctgacatgagcccttgcgggcccctcaacctgagcctggcgggcgaggcgaccacatgcgcggcgccctgggtccccaacacgtcggccgtgccgccgtcgggcgcttcgcccgcgctgcccatcttctccatgacgctgggcgccgtgtccaacctgctggcgctggcgctgctggcgcaggccgcgggccgcctgcgacgccgccgctcggccaccaccttcctgctgttcgtggccagcctgctggccaccgacctggcgggccacgtgatcccgggcgcgctggtgctgcgtctgtacactgcggggcgcgctccggccggcggggcctgccacttcctgggcggctgcatggtcttcttcggcctgtgcccgctgctgctgggctgtggcatggccgtggagcgctgcgtgggcgtcacgcggccgctgctccacgccgcgcgggtctcggtcgcccgcgcgcgcctggcgctggccgcggtggccgcggtggccttggccgtggcgctgctgccgctggcgcgcgtgggccgctatgagctgcagtacccgggcacgtggtgcttcatcggcctgggtcccccgggcggctggcgccaggcactgcttgctggcctcttcgccagcctcggcctggtcgcgctcctcgccgcgctggtgtgcaacacgctcagcggcctggccctgcatcgcgcccgctggcgacgccgctcccgacggcctcccccggcctcaggccccgacagccggcgtcgctggggggcgcacggaccccgctcggcctccgcctcgtccgcctcgtccatcgcttcggcctccaccttctttggcggctctcggagcagcggctcggcacgcagagctcgcgcccacgacgtggagatggtgggccagcttgtcggtatcatggtggtgtcgtgcatctgctggagcccaatgctggtgttggtggcgctggccgtcggcggctggagctctacctccctgcagcggccactgttcctggccgtgcgccttgcctcctggaaccagatcctggacccttgggtgtacatcctactgcgccaggccgtgctgcgccaactgcttcgcctcttgcccccgagggccggagccaagggcggccccgcggggctgggcctaacaccgagcgcctgggaggccagctcgctgcgcagctcccggcacagcggcctcagccacttctaagcacaaccagaggcccaacgactaagccagcccaccctgggctgggcccaggtgcgcggcgcagagcctttgggaataaaaagccattctgcg

SEQ ID NO: 1362 - DNA, 1406 bp; single-stranded, linear
  immediate source library: GENBANK
  immediate source clone: g413865
ccatgggcagcggcacacggcggcgcgatgatggacgttaacagcagcggccgcccggacctctacgggcacctccgctctttccttctgccagaagtggggcgcgggctgcccgacttgagccccgacggtggcgccgacccggtcgcgggctcctgggcgccgcacctgctgagcgaggtgacagccagcccggcgcccacctgggacgcgcccccggacaatgcctccggctgtggggaacagatcaactacggcagagtcgagaaagttgtgatcggctccatcctgacgctcatcacgctgctgacgatcgcgggcaactgcctggtggtgatctccgtgtgcttcgtcaagaagctccgccagccctccaactacctgatcgtgtccctggcgctggccgacctctcggtggctgtggcggtcatgcccttcgtcagcgtcaccgacctcatcgggggcaagtggatctttggacactttttctgtaatgtcttcatcgccatggacgtcatgtgctgcacggcctcgatcatgaccctgtgcgtgatcagcattgacaggtaccttgggatcacaaggcccctcacataccctgtgaggcagaatgggaaatgcatggcgaagatgattctctccgtctggcttctctccgcctccatcaccttacctccactctttggatgggctcagaatgtaaatgatgataaggtgtgcttgatcagccaggactttggctatacgatttactctaccgcagtggcattttatatccccatgtccgtcatgcttttcatgtactaccagatttacaaggctgccaggaagagtgctgccaaacacaagtttcctggcttccctcgagtggagccagacagcgtcatcgccctgaatggcatagtgaagctccagaaggaggtggaagagtgtgcaaacctttcgagactcctcaagcatgaaaggaaaaacatctccatctttaagcgagaacagaaagcagccaccaccctggggatcatcgtcggggcctttaccgtgtgctggctgccatttttcctcctctcgacagccagacccttcatctgtggcacttcctgcagctgcatcccactgtgggtggagaggacatttctgtggctaggctatgcaaactctctcattaacccttttatatatgccttcttcaaccgggacctgaggaccacctatcgcagcctgctccagtgccagtaccggaatatcaaccggaagctctcagctgcaggcatgcatgaagccctgaagcttgctgagaggccagagagacctgagtttgtgctacaaaatgctgactactgtagaaaaaaaggtcatgattcatgattgaaagcagaacaatggagaggaattcgatatcaagctta

SEQ ID NO: 1363 - DNA, 3459 bp; single-stranded, linear
  immediate source library: GENBANK
  immediate source clone: g425220
gaattcatgcttggtgacacttctcttcatattagaaaccttgatatgtttatcaatttatttaatttttactttacccctcactggagaatttgaaggtttcgcctgattcttgttaacatctgagtgccatgatttatttgttgacagtggggatgagatagtttttcattataacatttttcctgattctcgttaaatataacaataataggcaacatttctgagtgctaattgcctaccaactccttgtgttaagcactttactacttaattttcccccaccctataactcatgattcgcatgaagaaactgagtcttaaggaactctggaaccctacctgaggtttcacagcaagtaagtgcagtcgtactatcttactagcagggaaagacttgatttcaagtattctaaactctatttctagtagtctttcagtggatagtcccacttttttcagatagatcatcatatcaacaaataataattggtcctactcctttcaaatacttttattttcttccttttttgaactacttatactgcatgtatctatattaattattttaacacatatacatatcataacacactaatcaccaaacacttcaagaatagtgtaagatgacaggattgaaaataagaattacacattattcctttaacattgagtttcccagctttgaagtagctgaaataattatatcgcataaaaactttgttatatttttcactttcttattttcaaaaattataaaattgggtgtaagacattcttaattctaagaaaatgttgattttgcttatcttcatgtttttattcaattaaggacttttggtaaacatttgctggtgttaatgttaaaagagagttggggaaatggatggaggcaaccagagtgaaggttcagagttccttctcctggggatgtcagagagtcctgagcagcagcagatcctgttttggatgttcctgtccatgtacctggtcacggtggtgggaaatgtgctcatcatcctggccatcagctctgattcccgcctgcacacccccgtgtacttcttcctggccaacctctccttcactgacctcttctttgtcaccaacacaatccccaagatgctggtgaacctccagtcccataacaaagccatctcctatgcagggtgtctgacgcagctctacttcctggtctccttggtggccctggacaacctcatcctggctgtgatggcatatgaccgctatgtggccatctgctgccccctccactacaccacagccatgagccctaagctctgtatcttactcctttccttgtgttgggtcctatccgtcctctatggcctcatacacaccctcctcatgaccagagtgaccttctgtgggtcacgaaaaatccactacatcttctgtgagatgtatgtattgctgaggatggcatgttccaacattcagattaatcacacagtgctgattgccacaggctgcttcatcttcctcattccctttggattcgtgatcatttcctatgtgctgattatcagagccatcctcagaataccctcagtctctaagaaatacaaagccttctccacctgtgcctcccatttgggtgcagtctccctcttctatgggacactttgtatggtatacctaaagcccctccatacctactctgtgaaggactcagtagccacagtgatgtatgctgtggtgacacccatgatgaatcccttcatctacagcctgaggaacaaggacatgcatggggctctgggaagactcctagataaacactttaagaggctgacatgagggcaatttggaaagacagcattaaagtggagactaggaatatccttcaccctatgtaagggattgtcctgtgtgttatacagcagtgattgggacatggctccagctcagagacagcatatagatatgtggtgataaaaaagacatatttgtaacctggtgtcccccaggtctcatcagccttggccgtaaataaggtcacactaacaccaacactagaatgttgcagggtcaaattcttcaatgtacttgactacagggccacattcttggccttatctgactatatccagtttaaacctagaagtgtctctcatctagcacacatccaaagtacagaaagtaaatagtagctgataagaaagttagtcacatggctgtggaggtttgaaagagattgcaatcatacatatttgtatcagctgatccagcacgtgatatagacctcgacaggtggtgttcaattcatttgacattcatgcagtcattcatcaactcattctattcataatgacagtgtacagaggcctcaaactgggttacaaatgtgaggtcacagtctactcggggaagtacataaatttacattaaacataaatggacctaactcatcaattaaaaagtaatgttcaacatactgattaaaaaataaaatatagatagatgtatttaaagagacacgatgaaagcacaggaatatataaagcttgaaattaaaaagagaaacagacatatttggaaaatactaaatattttaagtgaaatattgctgcaatgacatcaggtaaaagatatttcaaaacgggtgaaaggagtgatgtcaacaagatggtggaatcgacagttgtatctctcatccaccaacatacagactaatttatcaaccatccacagatgaaaatacctttgtgagagctccagaatccaagtgaaagtttatagcaccctggtagtacacagaagtagaaaaaacaccatattgaacattgtagaaaaaactctgtcacattacctgaatcacccctcacccaagccagcacagagtagcacaaagagagatcccctcatctcatgagttcttccataagtaaaaaagaaaataaaacatatgtacaacttcccctgactttcaggatgctaaccaagaggaccacttctgtcatgcctcaccaagaatactgaggcaattcacatggccagacccctctgagtagctaagaacaagaaaaaaaaaaaaataagaaaatggttgggagctcttaatagtcagtatgtgtattttaacaactggggccttgcaccctacagtgggcctgtgcatggtgcccagaagctggcccatccacccacatccccaagcactaggcctgcctgcccatagaccctgccaactggccagcccagaatatctggctaagctgactggtgaaaaacagttcctatcaaattggactttccctatcaaaaccagcctgtaaagactaaaagagatgactgcttcttcaaatgtgcaaacacaaatgtgaagctacaggaaacacaaggaatcaaggaaacttagcaaagccaaaggaacaaaataaagcttcagaaaccatcaaagaaatggagaaatatgaactgcctgacaaagaattc

SEQ ID NO: 1364 - DNA, 1240 bp; single-stranded, linear
  immediate source library: GENBANK
  immediate source clone: g425267
ggcttccccaggactgttcctgctccggctcttcaggctccctgctttgtccttttccactgtccgcactgcatctgactcctgcagagaccttgttctcccacccgaccttcctctctgtcctcccctcccacctgcccctcagttcccaggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatgatgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtg

SEQ ID NO: 1365 - DNA, 1583 bp; single-stranded, linear
  immediate source library: GENBANK
  immediate source clone: g425351
caggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggaaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcaggtagtgtggctactccttgtcctatgcacatcctttaactgtcccctgattctgccccgccctgtcctcctctactgcttgattctttctcagaggtttgtggtttaggggaaagagactgggtctacagacctgaccctgcacaagccatttaatctcactcagcctctgt

SEQ ID NO: 1366 - DNA, 1285 bp; single-stranded, linear
  immediate source library: GENBANK
  immediate source clone: g431094
ttaccggtgatcggctctggcaccgccctgggccagagaaggaatgcctgcagtgtctggttcaggactcaccaccctggcgtcctcccttcttctcttgcagagcctgacgcaccccaggctgccgccatggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcggttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgccgcctgggtcctgtctctgtgcatgtcgctgccgctcttggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgacgcgcatggtgttggtggtggtgctggtgtttgcgggatgttggctgcccttcttcaccgtcaacatcgtcaacctggcggttgcgctgccccaggagcccgcctccgccggcctctacttcttcgtggtcatcctctcctacgccaacagctgtgccaaccccgtcctctacggcttcctctcggacaacttccgccagagcttccagaaggttctgtgcctccgcaagggctctggtgccaaggacgctgacgccacggagccgcgtccagacaggatccggcagcagcaggaggccacgcgcccgcgcaccgccgcagccaacgggcttatgcagaccagcaagctgtgagagtgcaggcggggggtgggcggccccgtgtcacccccaggagtcggaggttgcactgcggtga

SEQ ID NO: 1367 - DNA, 1840 bp; single-stranded, linear
  immediate source library: GENBANK
  immediate source clone: g432653
ggaagaggtaagcggttactcactccatggctgcagcaaggagaggcggcggcggcctcggctgaagaaagaagaaatcttcccaaggctgcagacaccgacggatttgctttgggagccagagtagctgccgccaccagagtccggagccatgagcggctttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggattcagcttaaaggcacctggagcagcttccggcacctccacaacaacatccaccgctgccaccgccaccgccaccaccaccaccagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagggcgaccatctacctgcagcacgcggatgaggagcgtcagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgtgggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacagacg

SEQ ID NO: 1368 - DNA, 2290 bp; single-stranded, linear
  immediate source library: GENBANK
  immediate source clone: g433200
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctccgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttggaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatggggtgggtggtagacccaactcatcaggcagcgggtagggcacagggaagagggagggtgtctcacaaccaaccagttcagaatgatacggaacagcatttccctgcagctaatgctttcttggtcactctgtgcccacttcaacgaaaaccaccatgggaaacagaatttcatgcacaatccaaaagactataaatataggattatgatttcatcatgaatattttgagcacacactctaagtttggagctatttcttgatggaagtgaggggattttattttcaggctcaacctactgacagccacatttgacatttatgccggaattc

SEQ ID NO: 1369 - DNA, 4035 bp; single-stranded, linear
  immediate source library: GENBANK
  immediate source clone: g434699
gaattccggccttcctaaggaaaggccagagcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcattctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctgaaggcccctcccagcagcggtaccccagggcctactgccacccgcttcctgtttcttagtccgaatgttagattcctcttgcctctctcaggagtatcttacctgtaaagtctaatctctaaatcaagtatttattattgaagatttaccggaattc

SEQ ID NO: 1370 - DNA, 3742 bp; single-stranded, linear
  immediate source library: GENBANK
  immediate source clone: g438372
gaattccttctctcctcctcctcgcccttctcctcgccctcctcctcctcctcgccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcacgttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcagcggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaaaaaaaaaaa

SEQ ID NO: 1371 - DNA, 648 bp; single-stranded, linear
  immediate source library: GENBANK
  immediate source clone: g438393
ctgccagatgtggggtgtgtcagtgtcactgtccctgccatgctgagccatttcatatccaacgacagaagcattccctataaggcctgcctctccgagctcttcttcttccacctcctggctggggcagactgcttcttgctgaccatcatggcctatgaccgctatctggccatctgccagtccctcacctacagcagccgcatgagctggggaatccagcaagccctggtgggcatgtcatgtgtcttttccttcaccaatgcactgacccaaactgttgccctgtctcctcttaacttctgtggccccaatgtgatcaatcacttctactgtgacctcccacagcccttccagctctcctgcgccagtgttcatctcaatgggcagttgctgtttgtagcagcagctttcatgggtgtggcccccttggtcctcatcactgtgtcctatgcccatgtggcagctgcagtcctgcgaatccgctctgcagagggcaaaaagaaagccttctccacgtgtagttcccacctcactgtggtgggcatcttctatgggacgggcgtcttcagctacacaaggctgggttcagtggagtcttcggacaaggacaagggcattggcatcctcaacactgtcatcagcccc

SEQ ID NO: 1372 - DNA, 645 bp; single-stranded, linear
  immediate source library: GENBANK
  immediate source clone: g438395
ttcactgacctcttctttgtcaccaacacaatccccaagatgctggtgaacttccagtcccagaacaaagccatctcctatgcagggtgtctgacacagctctacttcctggtctccttggtgaccctggacaacctcatcctggccgtgatggcgtatgatcgctatgtggccatctgctgccccctccactatgtcacagccatgagccctgggctctgtgtcttgctcctctccttgtgttgggggctgtctgttctctatggcctcctcctcaccttcctcctgaccagggtgaccttctgtgggcctcgagagatccactacctcttctgtgacatgtacatcctgctgtggctggcatgttccaacacccacatcattcacacagcattgattgccactggctgcttcatcttcctcaccctcttagggttcatgaccacatcctatgtacgtattgtcagaaccatccttcaaatgccctcggcctctaagaaatacaaaactttctctacctgtgcctcgcatttgggtgtggtctccctcttttatgggacgcttgctatggtgtacctgcagcccctccatacctactccatgaaggactcagtagccacagtgatgtatgctgtgctgacacct

SEQ ID NO: 1373 - DNA, 675 bp; single-stranded, linear
  immediate source library: GENBANK
  immediate source clone: g438404
ttctctgacctctgcttttcctcagtcacaatgcccaaattgctgcagaacatgcagaaccaagacccatccatcccctatgcagactgtctgacccaaatgtacttcttcttgtatttttcggatctagagagcttcctccttgtggccatggcctatgaccgctatgtggccatctgcttccccatgcactacaccgccatctgcttcctcctgcactacaccgccatcatgagccccatgctctgtctctccgtggtggcgctgtcctgggtgctgaccaccttccatgccatgttacacactttactcatggccaggttgtgtttttgtgcagacaatgtgatcccccactttttctgtgatatgtctgctctgctgaagctggcctgctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctctctgtggtgtcactgttctatgggaccgttattggtctctacttatgcccatcagctaatagttctactctaaaggacactgtcatggctatgatgtacactgtggtgacccct

SEQ ID NO: 1374 - DNA, 648 bp; single-stranded, linear
  immediate source library: GENBANK
  immediate source clone: g438410
cttgcagatgcctgctttgtgtccaccacagtccctaagatgctggcaaacatacagatccagagtcaggccatctcctacttagggtgtctactacagttgtattttttcatgttatttgtgatgctggaggcattcctcttggcggtcatggcctatgactgctacgtgggcatatgccacccacttcattacattctgatcatgagccctgggctctgcatcttcctcgtgtctgcatcctggatcatgaatgccctccactcccttctacacacacttctgatgaacagcctgtccttctgcgcaaaccatgagatcccacacttcttctgtgacatcaatcccctcctgagtctgtcctgcacagaccccttcaccaatgagctggtgatcttcatcactgggggtctcacaggactcatttgtgtgctttgcctgattatctcttacacgaacgttttctcgaccatcctgaagatcccatcagctcaggggaagcggaaagccttttccacctgcagctctcatctctccgtggtctctctcttctttgggacttctttttgtgttgatttcagttctccctcaacccactcggcccagaaggacacagttgcatcagtgatgtacacagtggtaactcca

SEQ ID NO: 1375 - DNA, 648 bp; single-stranded, linear
  immediate source library: GENBANK
  immediate source clone: g438412
ttctctgacctctgcttttcctcggtcacaatgcccaaattgctgcagaacatgcagagccaaaacccatccatcccctttgcggactgcctggctcagatgtactttcatctgttttatggagttctggagagcttcctccttgtggtcatggcttatcactgctatgtggctatttgctttcctctgcactacaccactatcatgagccccaagtgttggcttgctctgctgacactctcctggctgttgaccactgcccatgccacgttgcacaccttgcttatgggcagcctgtccttttgtgctgagaatgtgattcctcactttttctgtgatacatctaccttgttgaagctggcctgctccaacacgcaagtcaatgggtgggtgatgtttttcatgggcgggctcatccttgtcatcccattcctactcctcatcatgtcctgtgcaagaatcgtctccaccatcctcagggtcccttccactgggggcatccagaaggctttctccacctgtggcccccacctctctgtggtgtctctcttctatgggacaattattggtctctacttgtgcccattgacgaatcataacactgtgaaggacactgtcatggctgtgatgtacactggggtgacccac

SEQ ID NO: 1376 - DNA, 648 bp; single-stranded, linear
  immediate source library: GENBANK
  immediate source clone: g438416
gtgctggatgtcggatgtatcactgtcactgttcctgcaatgttgggtcgtctcttgtcccacaagtccacaatttcctatgacgcctgcctctcccagctcttcttcttccaccttctggctgggatggactgcttcctgctgaccgccatgggctatgaccgactcctgggcatctgccagcccctcacctacaggacccgcatgagtcagacagtccagaggatgttggtggctgcgtccttggcttgtgccttcaccaacgcactgacccacactgtgggcatgtccacgctcaacttctgtgggcccaatgaggtcaatcacttctactgtgacctcccacagctcttccagctctcctgctccagcacccaactcaatgagctgctgctctttgctgtgggtttcatcatggcaggcacacctttggttctcatcatcactgcctacagccacgtggcagctgcagttctacgaatccgttcagtggagggccgaaagaaggccttctccacgtgtggctcccacctcaccgtggtttgtcttttctttggaagaggtatcttcaactacatgagactgggttcagaggaggcttcagacaaggataaaggggttggagttttcaacactgttatcaaccct

SEQ ID NO: 1377 - DNA, 1578 bp; single-stranded, linear
  immediate source library: GENBANK
  immediate source clone: g439689
aagctttgccccagctgtgcagcccctgccagatgtgggaggcagctagctgcccagaggcatgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacggagctggtgtgcaacagaaccttcgacaagtattcctgctggccggacacccccgccaataccacggccaacatctcctgcccctggtacctgccttggcaccacaaagtgcaacaccgcttcgtgttcaagagatgcgggcccgacggtcagtgggtgcgtggaccccgggggcagccttggcgtgatgcctcccagtgccagatggatggcgaggagattgaggtccagaaggaggtggccaagatgtacagcagcttccaggtgatgtacacagtgggctacagcctgtccctgggggcgctgctcctcgccttggccatcctggggggcctcagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgcccccatgctgttcgtcgtcccctgggcagtggtcaagtgtctgttcgagaacgtccagtgctggaccagcaatgacaacatgggcttctggtggatcctgcggttccccgtcttcctggccatcctgatcaacttcttcatcttcgtccgcatcgttcagctgctcgtggccaagctgcgggcacggcagatgcaccacacagactacaagttccggctggccaagtccacgctgaccctcatccctctgctgggcgtccacgaagtggtcttcgccttcgtgacggacgagcacgcccagggcaccctgcgctccgccaagctcttcttcgacctcttcctcagctccttccagggcctgctggtggctgtcctctactgcttcctcaacaaggaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagagggcgtcgctggacaacccagaactggacgcccatctaga

SEQ ID NO: 1378 - DNA, 979 bp; single-stranded, linear
  immediate source library: GENBANK
  immediate source clone: g441149
ggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattc

SEQ ID NO: 1379 - DNA, 2162 bp; single-stranded, linear
  immediate source library: GENBANK
  immediate source clone: g452072
ggaattccggctataggcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccaacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctcgtgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctctaattctctaggaaagtgcctacttttaggtcatccaacctctttcctctctggccactctgctctgcacattagagggacagccaaaagtaagtggagcatttggaaggaaaggaatataccacaccgaggagtccagtttgtgcaagacacccagtggaaccaaaacccatcgtggtatgtgaattgaagtcatcataaaaggtgacccttctgtctgtaagattttattttcaagcaaatatttatgacctcaacaaagaagaaccatcttttgttaagttcaccgtagtaacacataaagtaaatgctacctctgatcaaagcaccttgaatggaaggtccgagtctttttagtgtttttgcaagggaatgaatccattattctattttagacttttaacttcaacttaaaattagcatctggctaaggcatcattttcacctccatttcttggttttgtattgtttaaaaaaaataacatctctttcatctagctccataattgcaagggaagagattagcatgaaaggtaatctgaaacacagtcatgtgtcanctgtagaaaggttgattctcatgcactncaaatacttccaaagagtcatcatgggggatttttcattcttaggctttcagtggtttgttcctggaattc

SEQ ID NO: 1380 - DNA, 1958 bp; single-stranded, linear
  immediate source library: GENBANK
  immediate source clone: g452495
cggcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcacatttagctgtgctcagaagggctatcatca

SEQ ID NO: 1381 - DNA, 1089 bp; single-stranded, linear
  immediate source library: GENBANK
  immediate source clone: g452756
ggctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccac

SEQ ID NO: 1382 - DNA, 1413 bp; single-stranded, linear
  immediate source library: GENBANK
  immediate source clone: g456426
agccctcccagtttccgcgcgcgtctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaac

SEQ ID NO: 1383 - DNA, 2494 bp; single-stranded, linear
  immediate source library: GENBANK
  immediate source clone: g456563
gtgcgcggaggggacgagcggctggaccacagccggcgcccgatcaggatctccgcgctgggatcggtggaacttgaggcagcggcggcgcggggcgccatggcacaccgagcggctccgtcttctgctcctcagagagcccggctggcggcctgggatgacaagatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagcggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaaattaagacatgtttggcaatatttcagttagttaaatacctgtagcctaactggaaaattcaggcttcatcatgtagtttgaagatactattgtcagattcaggttttgaaatttgtcaaataaacaggataactgtacattttcaacttgtttttgccaatgggaggtagacacaataaaataatgccatgggagtcacactgaaagcaattttgagcttatctgtcttatttatgctttgagtgaatcatctgttgaggtctaatgcctctacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcacatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaactctaccatggataatgcaaacaaaccgaagctacatgccaatgataggtgcaaagaatattggcaaaaggtgctttaccttgagccattatttgtgtcagagaacaaaagaaacagaatcaatatataaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgag

SEQ ID NO: 1384 - DNA, 1664 bp; single-stranded, linear
  immediate source library: GENBANK
  immediate source clone: g457562
agcccagagacacattggggctgacctgccgctgctgtcagtgggaggccagtggtgctggccaagaagtgtcatggctggtgtcgtgcacgtttccctggctgctcactgcggggcctgtccgtggggccggggcagactccgcaaaggacgcgcagcctgcaagtccgcggcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccct

SEQ ID NO: 1385 - DNA, 646 bp; single-stranded, linear
  immediate source library: GENBANK
  immediate source clone: g460081
agttaaatatctgaggatattcagggacttggatttggtggcaggagatcaacataaaccaagacaaggaagaagtcaaagaaatgaatcaagtagattctctgggatataaggtagggggattggggggttggatagtgcagagtatggtactggcctaaggcactgaggatcatccttttcccacacccaccagagaaggcttaggctcccgagtcaacagggcattcacgcctggggcgcctgagtcatcaggacactgccaggagacacagaaccctagatgccctgcagaatccttcctgttacggtccccctccctgaaacatccttcattgcaatatttccaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggtgagtgtagggtcttggggtcgaacgcgtgccactcgggagccacaggggttggatggggcctcctagacc

SEQ ID NO: 1386 - DNA, 1563 bp; single-stranded, linear
  immediate source library: GENBANK
  immediate source clone: g460902
taggaaacagaaattttccctggctattttctacccacagctgtcatgatcaacagatgttagccctttctgagcagaaaagaatcaaacactggaagatggcatctaaactcatcctgcctgagtccctggtgagctgttatttctggctttttacaggtgacttgactgtggccttgcctctgcttgtccctattgcctaggactcatagtgtccagcaggtgctttgaggcattttagccccagttattctctaggcaactaggcttggcacagtgggaactgggcacctcccaggtgatttactgatcctctttgctccttcctttctctgccttctcacttttttcccctaaatcttgtactgttcacatcttcagcacctggcctaccatgtaattcagaaatgggtggtaggacagcttctgaagtggcaagtactaaactatagcccattctcttctttagagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctata

SEQ ID NO: 1387 - DNA, 2214 bp; single-stranded, linear
  immediate source library: GENBANK
  immediate source clone: g463549
gttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccgagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagcttttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacactgagtggcccttcatgtacatccatggtgtgctggcttaaaatgtaattaatcttgtaaatatactcctagtaatttaagattttgtttttaaactggaaataaaagattgtatagtgcatgtttttt

SEQ ID NO: 1388 - DNA, 1472 bp; single-stranded, linear
  immediate source library: GENBANK
  immediate source clone: g466488
ggcgcgagggctggagctccgaagagggccgagtaggagctgcatggacagcatgcgtctctccgccggtcccgacgcggggccctcgggcaactccagcccatggtggcctctggccaccggcgctggcaacacaagccgggaggccgaagccctcggggagggcaacggcccaccgagggacgtgcgcaacgaggagctggccaaactggagatcgccgtgctggcggtgactttcgcggtggccgtgctgggcaacagcagcgtactgctggctctgcaccggacgccgcgcaagacgtcccgcatgcacctcttcatccgacacctcagcctggccgacctggccgtggcattcttccaggtgctgccgcaaatgtgctgggacatcacctaccgcttccgcggccccgactggctgtgccgcgtggtgaagcacctgcaggtgttcggcatgtttgcgtcggcctacatgctggtagtcatgacagccgaccgctacatcgcggtgtgccacccgctcaagactctgcaacagcccgcgcgccgctcgcgcctcatgatcgcggccgcctgggtgctgagcttcgtgctgagcacgccgcagtacttcgtcttctccatgatcgaggtgaacaatgtcaccaaggcccgcgactgctgggccaccttcatccagccctggggttctcgtgcctacgtgacctggatgacgggcggcatctttgtggcgcccgtggtcatcttgggtacctgctacggcttcatctgctacaacatctggtgcaacgtccgcgggaagacggcgtcgcgccagagcaagggtgcagagcaagcgggtgtggccttccaaaaggggttcctgctcgcaccctgtgtcagcagcgtgaagtccatttcccgggccaagatccgcacggtgaagatgacttttgtgatcgtgacggcttacatcgtctgctgggcgcctttcttcatcatccagatgtggtctgtctgggatcccatgtccgtctggaccgaatcggaaaaccctaccatcaccatcactgcattactgggttccttgaatagctgctgtaatccctggatatacatgttttttagtggccatctccttcaagactgtgttcaaagcttcccatgctgccaaaacatgaaggaaaaattcaacaaagaagatactgacagtatgagcagaagacagactttttattctaacaatcgaagcccaacaaacagtacgggtatgtggaaggactcgcctaaatcttccaagtccatcaaattcattcctgtttcaacttgagccttgcattcatgcaacttgattcttgtgattgactttttggctcattagctgaattgagctagaaatcacaagaacaaatacactttattaatataaccataaatcaattcattgtgtatgagactgtgtttctagttgcatttcatattgctaccaaacc

SEQ ID NO: 1389 - DNA, 2372 bp; single-stranded, linear
  immediate source library: GENBANK
  immediate source clone: g468150
gagaaatggcgtggcaggggacccagcgagcccagagggattttgccgctgcttcctctacccctgtatttcacgcagctctctaaattgactcagctccaggctagtgtgagaaacaccaacagcaggcccatctcagatcttcactatggcaacttatgcaagaaactgttgaattagacccgtttcctatagatgagaaaccatacaagctgtggtatttatgagcctccatttcttatactactgcagtgaaccaacattggatgtgaaaattgccttttgtcagggattcgataaacaagtggatgtgtcatatattgccaaacattacaacatgagcaaaagcaaagttgacaaccagttctacagtgtggaagtgggagactcaaccttcacagttctcaagcgctaccagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgccacaaaatcctctttccaggaagggactatattgaccagtggaataaggtaattgaacaactaggaacaccatgtccagaattcatgaagaaattgcaacccacagtaagaaactatgtggagaatcggcccaagtatgcgggactcaccttccccaaactcttcccagattccctcttcccagcggactccgagcacaataaactcaaagccagccaagccagggacttgttgtcaaagatgctagtgattgacccagcaaaaagaatatcagtggacgacgccttacagcatccctacatcaacgtctggtatgacccagccgaagtggaggcgcctccacctcagatatatgacaagcagttggatgaaagagaacacacaattgaagaatggaaagaacttatctacaaggaagtaatgaattcagaagaaaagactaaaaatggtgtagtaaaaggacagccttctccttcagcacaggtgcagcagtgaacagcagtgagagtctccctccatcctcgtctgtcaatgacatctcctccatgtccaccgaccagaccctggcatctgacactgacagcagcctggaagcctcggcaggacccctgggttgttgcaggtgactagccgcctgcctgcgaaacccagcgttcttcaggagatgatgtgatggaacacacacacacgcagacacacacacacacacaaatgcagacacacaacatcaagaaaacagcaagggagagaatccaagcctaaaattaaataaatctttcagcctgcttcttccccagggttctgtattgcagctaagctcaaatgtatatttaacttctagttgctcttgctttggtcttcttccaatgatgcttactacagaaagcaaatcagacacaattagagaagccttttccataaagtgtaattttaatggctgcaaaaccggcaacctgtaactgcccttttaaatggcatgacaaggtgtgcagtggccccatccagcatgtgtgtgtctctatcttgcatctacctgctccttggcctagtcagatggatgtagatacagatccgcatgtgtctgtattcatacagcactacttacttagagatgctactctcagtgtcctcagggctctaccaagacataatgcactggggtaccacatggtccatttcatgtgatctattactctgacataaacccatctgtaatatattgccagtatataagctgtttagtttgttaattgattaaactgtatgtcttataagaaaacatgtaaagggggaatatattgggggagtgagctctctcagacccttgaagatgtagcttccaaatttgaatggattaaatggcacctgtatacca

SEQ ID NO: 1390 - DNA, 3186 bp; single-stranded, linear
  immediate source library: GENBANK
  immediate source clone: g468707
agttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagc

SEQ ID NO: 1391 - DNA, 1973 bp; single-stranded, linear
  immediate source library: GENBANK
  immediate source clone: g471316
ctgccggctcactcggctgctgcgtctggtctggcgtctgctgagaagatcctcttctaccctgctctgcacctgtgctcgactgccagccggctgagggcgggggtctccacggtggtcccagctcccaaggaggttgcagaagtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgttactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcacggcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcag

SEQ ID NO: 1392 - DNA, 2232 bp; single-stranded, linear
  immediate source library: GENBANK
  immediate source clone: g472555
ggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttgctatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctaatttgccagtgggaactcctaaatcaaattggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaag

SEQ ID NO: 1393 - DNA, 1790 bp; single-stranded, linear
  immediate source library: GENBANK
  immediate source clone: g475197
tactaaccatgctgaccactgttcggaacgggattgaatcacagaaaaacagcaaatggctctctcttacagagtgtctgaacttcaaagcacaattcctgagcacattttgcagagcacctttgttcacgttatctcttctaactggtctggattacagacagaatcaataccagaggaaatgaaacagattgttgaggaacagggaaataaactgcactgggcagctcttctgatactcatggtgataatacccacaattggtggaaatacccttgttattctggctgtttcactggagaagaagctgcagtatgctactaattactttctaatgtccttggcggtggctgatttgctggttggattgtttgtgatgccaattgccctcttgacaataatgtttgaggctatgtggcccctcccacttgttctatgtcctgcctggttatttcttgacgttctcttttcaaccgcatccatcatgcatctctgtgccatttcagtggatcgttacatagccatcaaaaagccaatccaggccaatcaatataactcacgggctacagcattcatcaagattacagtggtgtggttaatttcaataggcattgccattccagtccctattaaagggatagagactgatgtggacaacccaaacaatatcacttgtgtgctgacaaaggaacgttttggcgatttcatgctctttggctcactggctgccttcttcacacctcttgcaattatgattgtcacctactttctcactatccatgctttacagaagaaggcttacttagtcaaaaacaagccacctcaacgcctaacatggttgactgtgtctacagttttccaaagggatgaaacaccttgctcgtcaccggaaaaggtggcaatgctggatggttctcgaaaggacaaggctctgcccaactcaggtgatgaaacacttatgcgaagaacatccacaattgggaaaaagtcagtgcagaccatttccaacgaacagagagcctcaaaggtcctagggattgtgtttttcctctttttgcttatgtggtgtcccttctttattacaaatataactttagttttatgtgattcctgtaaccaaactactctccaaatgctcctggagatatttgtgtggataggctatgtttcctcaggagtgaatcctttggtctacaccctcttcaataagacatttcgggatgcatttggccgatatatcacctgcaattaccgggccacaaagtcagtaaaaactctcagaaaacgctccagtaagatctacttccggaatccaatggcagagaactctaagtttttcaagaaacatggaattcgaaatgggattaaccctgccatgtaccagagtccaatgaggctccgaagttcaaccattcagtcttcatcaatcattctactagatacgcttctcctcactgaaaatgaaggtgacaaaactgaagagcaagttagttatgtatagcagaactggcagttgtcatcaaacataatgatgagtaagatgatgaatgagatgtaaatgtgcccagaatatattatataaagaattttatgtcatatatcaaatcatctctttaacctaagatgtaagtattaagaatatctaattttcctaatttggacaagattattccatgaggaaaataattttatatagctacaaatgaaaacaatccagcactctggttaaattttaaggtattcgaatgaaataaagtcaaatcaataaatttcaggctttaaaaaaaaaa

SEQ ID NO: 1394 - DNA, 1680 bp; single-stranded, linear
  immediate source library: GENBANK
  immediate source clone: g487338
aaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacacttt

SEQ ID NO: 1395 - DNA, 1800 bp; single-stranded, linear
  immediate source library: GENBANK
  immediate source clone: g487340
gatagtgctgaagaggaggggcgttcccagaccatggcatctacggaaggtgccaacaatatgcccaagcaggtggaagtgcgaatgccagacagtcatcttggctcagaggaacccaagcaccggcacctgggcctgcgcctgtgtgacaagctggggaagaatctgctgctcaccctgacggtgtttggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacagattcaaacagtgacgaagaaagtcctggttgcaccaccgccagacgaggaggccaacgcaaccagcgctgaagtctctctgttgaacgagactgtgactgaggtgccggaggagactaagatggttatcaagaagggcctggagttcaaggatgggatgaacgtcttaggtctgatagggtttttcattgcttttggcatcgctatggggaagatgggagatcaggccaagctgatggtggatttcttcaacattttgaatgagattgtaatgaagttagtgatcatgatcatgtggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccctttttgctggcattttccaagcttggatcactgccctgggcaccgcttccagtgctggaactttgcctgtcacctttcgttgcctggaagaaaatctggggattgataagcgtgtgactagattcgtccttcctgttggagcaaccattaacatggatggtacagccctttatgaagcggtggccgccatctttatagcccaaatgaatggtgttgtcctggatggaggacagattgtgactgtaagcctcacagccaccctggcaagcgtcggcgcggccagtatccccagtgccgggctggtcaccatgctcctcattctgacagccgtgggcctgccaacagaggacatcagcttgctggtggctgtggactggctgctggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtaactctggcagccaatggaaagtcagccgactgcagtgttgaggaagaaccttggaaacgtgagaaataaggatatgagtctcagcaaattcttgaataaactccccagcgt

SEQ ID NO: 1396 - DNA, 1674 bp; single-stranded, linear
  immediate source library: GENBANK
  immediate source clone: g487342
atagcggcgacagccatggggaaaccggcgaggaaaggatgcccgagttggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggaccgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttcgtgagagtcatctcaaacacggcttaaggaaaagagaaa

SEQ ID NO: 1397 - DNA, 3090 bp; single-stranded, linear
  immediate source library: GENBANK
  immediate source clone: g487427
gaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtcttccttcacttcccccattgccaccccccaatcccagtacccccatcggtctgttcacatctctgtgttcatcttggcaagacctactcaatcaagtgatgatgccagttgataaacttccctggaaaacatttacagctattccatttggcaaacttgcttctctgtcaatatttcatcctcctttaaaccaggagggttattaatggcaaaagcattggtcttctttatgcttgatcagtatgactcaaattaaaagtgttctgctgtgtatatcaactcagtagcccacacccagttatctgggagctgatggttcagtcactgtattacccaaatctttcctgccagctgcctttcagacatttgttaaatcccaaccagagaccgggcagatagagagaagtaaatctgaagtgcgtttt

SEQ ID NO: 1398 - DNA, 2643 bp; single-stranded, linear
  immediate source library: GENBANK
  immediate source clone: g487782
ttttttcctgagacagagtcttgctctgttgcccaggctggagtgcaatggcacaatctcaactcactgcaacctccaccccctgagttcgagcaattctcctgccttggctcccgagtagctgggattacaggcgcctcaccatgcctggctaatttttgtatttttagtagagacggagtttcagcatttgcaggtgattttgaactgctgacctcaggtgatccacctgcctcagcctcccaaaatgctgggattacaggcatgagccactgcgcccagccgagagttttaaagaaggtgaaagctcttcccttttcctaacctagcctggccttgattccgctgatctaccttctgagatatcatccttcttcagggagataaggaaaaaaagccacagggtcccggagagccaggggaatgttttgtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccaggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagacagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttatgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaatcacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggcttcggttgtaataaacttggcttctttataaaaaaaaaaaaaaaaaaaaaaaaaaaaaaaaaaaactttagagcacactggggtaccggatcc

SEQ ID NO: 1399 - DNA, 2582 bp; single-stranded, linear
  immediate source library: GENBANK
  immediate source clone: g487837
aaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtctgggaagattttccagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggtttcagttacattcaagcctgcttcgtacatcggcgaatcctcgcccggtgaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactgggggaaaaccttatgagtgtgacaagtgtaggaaatcctttacttctaagaggaacttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctataaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatggggggcacacacctgtaatcccagctactcaggaggctgagacaggagagtcgcttgaacctgggagggcggaggttgcagtgagccaggatctggccattgcactccagcctgggcacaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggagtgccgaggtgggaagatcccttgagcccaggagttcgagacaagcctgggtaacacggggagacccgtctttagtaaataaaaataaatttattaataaaactaaaagg

SEQ ID NO: 1400 - DNA, 1189 bp; single-stranded, linear
  immediate source library: GENBANK
  immediate source clone: g487839
gggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaactcacacttattatcaccagagaattcacactggtgagaaaccctatgaatgtaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaaggtcctcagtgctgcgttggtcagtttcttaaggtatggttctctagagacagagagcaaggacctttgagttaagctgtctttataagcaggatgctcatagtggaaacccggagccagtagacacggtggaccattccctacttccttttccttggatcactaaggtgggagagtagtagtagcttattccagttcttacccattattaggaaggtaaggactacacatgtcattgaattgtaggtttcctttttttttctttacttttaaattttaacttttaaaatctatttcatttcttagttatgcatctcataatcagactccatgctttttaaagacagagataatatcttctctattctattctacttcctccatttcaccatttatacaaagtcattcaaaaaggctgattcatgccttcctgcctcttggctatggccctccccatctactctttaaactttaatctataacttttcatcagttttgttccctatctagaaaacattttcttctgtttgctaatctttgtccctcacaatttttgaaatccatctcatcactgaaatactttcttcttcaagtacttttttatttttcttcaacttctcttgatttgacctcagtgcttt

SEQ ID NO: 1401 - DNA, 2368 bp; single-stranded, linear
  immediate source library: GENBANK
  immediate source clone: g488550
ctaaagctagtggatgtgaagtggtatctcattatggttttggttttcatactcctcatgtttaaggatgctgaacttcttttcatatgcttattggccatttgtgtatatatcttcttttagagaaatgtctatttaagtcctttgacccatttctgtgtccttacccctggtgaggtctcccttattctgttgcttggctggtccctatcctgccaatagtaatgggcccttcttcaccctgatgatggccctgttggcctgtcagcaatccctgggacctcttcttgggtgtgaattcctgggtaacatttctaatgaagtcaaccattcccaccaagtggaattcttagttaactggcatttctctactttcaggttcttggcaatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaagtttcacactggggaaataccccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggtgaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctccatgctttag

SEQ ID NO: 1402 - DNA, 1738 bp; single-stranded, linear
  immediate source library: GENBANK
  immediate source clone: g494982
gccaggagggcgcctctgggaagaagaccacgggggaagcaaagtttcagggcagctgaggagccttcgccgcagcccttccgagcccaatcatcccccaggctatggagggcggactctaagatgaatcccgacctggacaccggccacaacacatcagcacctgcccactggggagagttgaaaaatgccaacttcactggccccaaccagacctcgagcaactccacactgccccagctggacatcaccagggccatctctgtgggcctggtgctgggcgccttcatcctctttgccatcgtgggcaacatcctagtcatcttgtctgtggcctgcaaccggcacctgcggacgcccaccaactacttcattgtcaacctggccatggccgacctgctgttgagcttcaccgtcctgcccttctcagcggccctagaggtgctcggctactgggtgctggggcggatcttctgtgacatctgggcagccgtggatgtcctgtgctgcacagcgtccattctgagcctgtgcgccatctccatcgatcgctacatcggggtgcgctactctctgcagtatcccacgctggtcacccggaggaaggccatcttggcgctgctcagtgtctgggtcttgtccaccgtcatctccatcgggcctctccttgggtggaaggagccggcacccaacgatgacaaggagtgcggggtcaccgaagaacccttctatgccctcttctcctctctgggctccttctacatccctctggcggtcattctagtcatgtactgccgtgtctatatagtggccaagagaaccaccaagaacctagaggcaggagtcatgaaggagatgtccaactccaaggagctgaccctgaggatccattccaagaactttcacgaggacacccttagcagtaccaaggccaagggccacaaccccaggagttccatagctgtcaaactttttaagttctccagggaaaagaaagcagctaagacgttgggcattgtggtcggtatgttcatcttgtgctggctacccttcttcatcgctctaccgcttggctccttgttctccaccctgaagccccccgacgccgtgttcaaggtggtgttctggctgggctacttcaacagctgcctcaaccccatcatctacccatgctccagcaaggagttcaagcgcgctttcgtgcgcatcctcgggtgccagtgccgcggccgcggccgccgccgacgccgccgccgccgtcgcctgggcggctgcgcctacacctaccggccgtggacgcgcggcggctcgctggagcgctcgcagtcgcgcaaggactcgctggacgacagcggcagctgcctgagcggcagccagcggaccctgccctcggcctcgccgagcccgggctacctgggccgcggcgcgccaccgccagtcgagctgtgcgccttccccgagtggaaggcgcccggcgccctcctgagcctgcccgcgcctgagccccccggccgccgcggccgccacgactcgggcccgctcttcaccttcaagctcctgaccgagcccgagagccccgggaccgacggcggcgccagcaacggaggctgcgaggccgcggccgacgtggccaacgggcagccgggcttcaaaagcaacatgcccctggcgcccgggcagttttagggcccccgtgcgcagctttctttccctggggaggaaaacatcgtggggggga

SEQ ID NO: 1403 - DNA, 1417 bp; single-stranded, linear
  immediate source library: GENBANK
  immediate source clone: g495042
ggcacagacgcacgggacaggagagcctgggcaagactggagagcccagacctgggatggcggattcgtgcaggaacctcacctacgtgcggggctcggtggggccggccaccagcaccctgatgttcgtggccggtgtggtgggcaacgggctggccctgggcatcctgagcgcacggcgaccggcgcgcccctcggccttcgcggtgctggtcaccggactggcggccaccgacctgctgggcaccagcttcctgagcccggccgtgttcgtggcctatgcgcgcaacagctccctgctgggcctggcccgaggcggccccgccctgtgcgatgccttcgccttcgccatgaccttcttcggcctggcgtccatgctcatcctctttgccatggccgtggagcgctgcctggcgctgagccacccctacctctacgcgcagctggacgggccccgctgcgcccgcctggcgctgccagccatctacgccttctgcgtcctcttctgcgcgctgcccctgctgggcctgggccaacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctccgggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctggggccgatcagctgctgtttctctgcggcagggcagtcgctgctggctctgggaagagagtgagggacagaggaaacgtttatcctggag

SEQ ID NO: 1404 - DNA, 3945 bp; single-stranded, linear
  immediate source library: GENBANK
  immediate source clone: g495472
cgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgaagtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatctgccgtctgccagtgccgcgtcggggacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtccggacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggcgtggctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagcccgtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagcgtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagatgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 1405 - DNA, 1773 bp; single-stranded, linear
  immediate source library: GENBANK
  immediate source clone: g497313
ccgaggagcctgcgctgctcctggctcacagcgctccgggcgaggagagcgggcggaccggggggctgggccggtgcgggcggcgaggcaggcggacgaggcgcagagacagcggggcggccggggcgcggcacgcggcgggtcggggccggcctctgccttgccgctcccctcgcgtcggatccccgcgcccaggcagccggtggagagggacgcggcggacgccggcagccatggaaccggccccctccgccggcgccgagctgcagcccccgctcttcgccaacgcctcggacgcctaccctagcgccttccccagcgctggcgccaatgcgtcggggccgccaggaccggggagcgcctcgtccctcgccctggcaatcgccatcaccgcgctctactcggccgtgtgcgccgtggggctgctgggcaacgtgcttgtcatgttcggcatcgtccggtacactaagatgaagacggccaccaacatctacatcttcaacctggccttagccgatgcgctggccaccagcacgctgcctttccagagtgccaagtacctgatggagacgtggcccttcggcgagctgctctgcaaggctgtgctctccatcgactactacaatatgttcaccagcatcttcacgctcaccatgatgagtgttgaccgctacatcgctgtctgccaccctgtcaaggccctggacttccgcacgcctgccaaggccaagctgatcaacatctgtatctgggtcctggcctcaggcgttggcgtgcccatcatggtcatggctgtgacccgtccccgggacggtgcagtggtgtgcatgctccagttccccagccccagctggtactgggacacggtgaccaagatctgcgtgttcctcttcgccttcgtggtgcccatcctcatcatcaccgtgtgctatggcctcatgctgctgcgcctgcgcagtgtgcgcctgctgtcgggctccaaggagaaggaccgcagcctgcggcgcatcacgcgcatggtgctggtggttgtgggcgccttcgtggtgtgttgggcgcccatccacatcttcgtcatcgtctggacgctggtggacatcgaccggcgcgacccgctggtggtggctgcgctgcacctgtgcatcgcgctgggctacgccaatagcagcctcaaccccgtgctctacgctttcctcgacgagaacttcaagcgctgcttccgccagctctgccgcaagccctgcggccgcccagaccccagcagcttcagccggccccgcgaagccacggcccgcgagcgtgtcaccgcctgcaccccgtccgatggtcccggcggtggccgtgccgcctgaccaggccatccggcccccagacgcccctccctagttgtacccggaggccacatgagtcccagtgggaggcgcgagccatgatgtggagtggggccagtagataggtcggagggctttgggaccgccagatggggcctctgtttcggagacgggaccgggccgctagatgggcatggggtgggcctctggtttggggcgaggcagaggacagatcaatggcgcagtgcctctggtctgggtgcccccgtccacggctctaggtggggcgggaaagccagtgactccaggagaggagcgggacctgtggctctacaactgagtccttaaacagggcatctccaggaaggcggggcttcaaccttgagacagcttcggtttctaacttggagccggactttcggagttggggggtccggggccc

SEQ ID NO: 1406 - DNA, 656 bp; single-stranded, linear
  immediate source library: GENBANK
  immediate source clone: g498718
aaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcctttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaac

SEQ ID NO: 1407 - DNA, 1812 bp; single-stranded, linear
  immediate source library: GENBANK
  immediate source clone: g498724
attcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaacagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaacataagattcacaaagaggaaacttcatgaaccagatgaatatagaatagacttctttgaaattcatagtttacagaattttaatgagagaaattattgagctaatgaatggcagaattaacaaaattacaaacattttatgtatcggaaggatataccttggagggaccatgctatgagggaaagtgtaaatctagaaatgagaaacccctagggaaaaaatatatataggagtgaacatcttatgaatgtaccaaataaaccacagctggactgttaacctcaccttagaagcttcattc

SEQ ID NO: 1408 - DNA, 3608 bp; single-stranded, linear
  immediate source library: GENBANK
  immediate source clone: g505664
gaattcgtgtctcggcactcactcccggccgcccggacagggagctttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcaatgtacctaatatataccaggacaccacaatttcttggtggaaagatgggaaggaattgcttgggggacatcatcgaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatcccccggcgtgctaactgttccaggcctgacggagatggcggtcttcagttgtgaggcccacaatgacaaagggctgaccgtgtcccagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgggtaatggctcagtcatgatttttaacacctctgccttaccacatctgtaccaaatcaagcagctgcaagccctggctaattacagcattggtgtttcctgcatgaatgaaataggctggtctgcagtgagcccttggattctagcaagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacatcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatacgtacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggccccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaaggaagctgtcattaaaaatacataatatatatttatttaaagagaaaaaatatgtgtatatcatgaaaaagacaaggatattttaataaaacattacttatttcatttcacttatcttgcatatcttaaaattaagcttcagctgctccttgatattaacctttgtacagagttgaagttgttttttcaacttcttttctttttcattactattaaatgtaaaaatatttgtaaaatgaaatgccatatttgacttggcttctggtcttgatgtatttgataagaatgattaattttctgatatggcttccataataaaattgaaatagga

SEQ ID NO: 1409 - DNA, 2100 bp; single-stranded, linear
  immediate source library: GENBANK
  immediate source clone: g507150
ggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatggcaacctacagctggagtcgagagtctggggcaatggggcaggaaaagtgttactacattaccatctttgcctctgcgcaccccgagaagctcaccttgtggtctacggtcctgtccacctaccactttgggggcaatgcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcgaagtgcaggtttctgattggctcatcttcttcgcctccctggggagcttcctgagcatccttctcgtgggcgtccttggctaccttggcctgaacagggccgcacggcacctgtgcccgccgctgcccacaccctgtgccagctccgccattgagttccctggagggaaggagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaagatgtgatcgttgaggctcagagagggtgagtgactcgcccgaggctacgtagc

SEQ ID NO: 1410 - DNA, 3056 bp; single-stranded, linear
  immediate source library: GENBANK
  immediate source clone: g507826
tgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaacgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattaatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaggaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgattttttttttccttcagtgccttatggaacactctgagactcgcgacaatgcaaaccatcattgaaatctttttgctttgcttgaaaaaaaataattaaaataaaaaccaacaaaaatggacatgcatcaaacccttgatgtattaatatttattatagttttcatta

SEQ ID NO: 1411 - DNA, 1742 bp; single-stranded, linear
  immediate source library: GENBANK
  immediate source clone: g510295
atgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaaaaaaaaaa

SEQ ID NO: 1412 - DNA, 4079 bp; single-stranded, linear
  immediate source library: GENBANK
  immediate source clone: g516262
gactggctgcagccgcagtcttggtggaggaggtggtgaccaccaccgctcctccacctgcatccggctgcgggactgcggcggccgcgtttgccctgcagaccctgcaccccgggacgcggctcatctgtcattagcaccggcactaagctcccaccgctcagcgacttggtccgccgcaagctccgccgcaggctttgtccgctagcgctcggctgagtctgggcgggcgggaaacctgggctagggcgaggcggggcccctggacatgcctttctccacgtccgcctcctcgaccctattgtaagcggagaaacttagtgtgcgaggcaggcaggggacgtccccattttgatgtcccgtaccctccacccccttcggatcgaggtagtaaagaggctcctgtaggaaactgactgcctctatgattgcggcctcttgggggattttgcgtttagcccgaaagttggctttgccaaaagacgcacgggtaggaagggcgaaaaggaaaccctgtattccgtcgcgctgggctctccgagtccgtgcgcaaagcggcctacgagtcctggctccgcacctgcagaggacaagagccaatgcctaaaaaagaacagcggaggaaccggctggcgcggccagctggaacgctggatcgcagtgcgcccagggaaggccgggggcgcccgccggccctagccctcagtggtcctctcccacgccggcccgcgcgtgcctctgcctacaagacctggggcgtcctggccagatctggatggcaggtccctccgccacccccggcccggttccgggggcgtggcttggcgcgggggcgggtttaagtcaccgcgggtgtctgaccactctgacaggtctccaaatttctcccagtcgcctggcgcccgcggtgcgtttcagagctccagggtggcacgcggcggcgcttccctagatccagaggcgtctctgtcgacttccacgcggcctcgggcctcccttctcctccaaaccttcgcctcatccgccaagcttcggttctcagcctcagatatccgcaccggcggcttctcttcgttctcggagctcttggctttggagccctcaccactttttccttcccccgcctctcctgatcctcctagctccgagccaaatggactccaaagaacgaaataaaggggatgagaactgtgtgctgcgacccttcgaaagcacagctgaaagcgttgacctcgtcttatagatcaggctgggaccctggggcgagagtccccacaccccctccgggagggatgcttctggccagagccagcgctgcgctgtcagtccttgctcccgaactaggaaagagcctaggagggagcctcagcataccccttcctccaaattaactatttggtgaattgttagcgccgaggctaccacctctccaaccctgtcgcggggcgcgccgccacctcaccgtgaccccctcctcctccttctttgccaccgcccccagctccgcccctgctccccatcccggcgcaatggagttctccgaagggcgatgattccagccacatctgctaacttcgcacccatcgctgccgccggtcaccgccggccaggccccctgcagccgcggagcagtgggcgtccaaagcccagtgcagcagccaggacccgcccgacgcgcagcagaagcacggcgcccaggcgcttaggcgtctcttggagagcaaaggctgcgccaaaacgctgagcctagaatcaaccaaggagcctgagcccaggaaggggctgcgtggctcacagcgctgcggctcctgaggacaaatagccactgccgctgcgtacccaagctgcgccggctggcgggagagcagcacgcaaggacgccgaggtccgccgcgatcttccaggtgccctttgcccctgggcacagtatgacccgacctacagggagccctagcgcagggctcctgcaacgggtcagcctaggataaaaaggatccttgccaagctcctaccaggccgcctttgagtctttaggaacccctcctccggctgcctccccaaggttctgggcctccttccctgcggcccagagccatggagctctccgatgtgcgctgccttacaggcagcgaggaactctacaccatccacccgacgcccccggccggcgacggcaggagcgcctcccggccgcagcggctgctgtggcagacggcggtgcgacacatcacggagcagcgcttcattcacgggcaccggggaggcagcggcagcgggagtggaggctcgggcaaagcctcggaccctgcgggcggcggccccaaccaccacgcgccgcagctgtcaggcgactcggcgctgcccctctactcgctgggcccgggagagcgagcgcacagcacctgcggcaccaaagtcttcccggaacgcagcgggagcggcagtgccagcggcagcggaggcgggggcgacctgggcttcctgcaccttgactgtgcccctagcaactcggatttctttcttaatgggggctatagctaccgaggggtcattttccccaccctgcgcaactccttcaaatctcgggatttggaacgcctctaccagcgctatttcttgggccaaaggcgcaaatcggaagtggtgatgaacgtgctggacgtgctgaccaaactcactctcttggtcctacacttgagcctggcctcggcccccatggacccgctcaagggcatcctgctgggcttcttcaccggcattgaggtagtgatctgcgccctggtggtggtcaggaaggacaccacctcccacacgtacctgcagtacagcggcgtggtcacctgggtggccatgaccacccagatcctggcagcaggcctcggctacgggctcctgggcgacggcataggctacgtgctcttcacgctcttcgccacctacagtatgctgccgctgccgctcacctgggccatcctggccggcctgggcacctcgctgctgcaggtcatcctccaagtggtcataccccggctggcggtcatttccatcaaccaggttgtggcccaggcagtgctattcatgtgtatgaacacagctggaatcttcatcagttacctgtcagaccgggcccagcgccaagctttcctggagactcggaggtgtgtggaggccaggctgcgcctggagacagagaaccaaagacaggagcggctcgtgctttctgtgctcccccggtttgttgtcctggaaatgatcaacgacatgaccaatgtggaagatgagcacctgcagcaccagttccatcggatctacatccatcgctatgagaacgtcagtattctttttgcagatgttaaaggatttaccaacctctccacgaccttgtctgctcaggagctggtcaggatgctcaacgagctctttgccagatttgatcgactggcccatgagcatcactgccttcgtattaaaatcctgggggactgctactactgcgtgtctggacttcctgagccccgccaggaccatgcccactgctgtgttgaaatgggtctcagcatgatcaaaaccatcaggtatgtgcggtcaaggacaaaacacgatgttgacatgaggattggaatccactccggctcggtgctgtgcggtgttttgggactacggaagtggcagtttgatgtctggtcttgggatgtggatattgcaaacaaactcgaatctggaggaatccccgggaggattcacatttccaaagccacgctggactgtctcaacggtgactataacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatactctggctgccctaacaagaaattcaataaatctgcttccaaaccatcttgcacaagctttgcatgtccagtc

SEQ ID NO: 1413 - DNA, 1282 bp; single-stranded, linear
  immediate source library: GENBANK
  immediate source clone: g516319
gtagtgtggcctaaggagccccaaattccttacttgtanagagggaacgtgnnagaggcccggncaagaagaagggggtctgtttctttttcttgagtaaanaaattattgggaggagtgattcttttcccnccctggatgtttctttgcaggaactcatgcagccagaatctggggccaatggaacagtcattgctgagttcatcctgctgggcttgctggaggcgccagggctgcagccagttgtctttgtgctcttcctctttgcctacctggtcacggtcaggggcaacctcagcatcctggcagctgtcttggtggagcccaaactccacacccccatgtacttcttcctggggaacctatcagtgctggatgttgggtgcatcagcgtcactgttccatcaatgttgagtcgtctcctgtcccgcaagcgtgcagttccctgtggggcctgccttacccagctcttcttcttccatctgttcgttggagtggactgcttcctgctgaccgccatggcctatgaccaattcctggccatctgccggcccctcacctacagcacccgcatgagtcagacagtccagaggatgttggtggctgcgtcctgggcttgtgctttcaccaacgcactgacccacactgtggccatgtccacgctcaacttctgtggccccaatgtgatcaatcacttctactgtgacctcccacagctcttccagctctcctgctccagcacccaactcaatgagctgctgctttttgctgtgggttttataatggcaggtacccccatggctctcattgtcatctcctatatccacgtggcagctgcagtcctgcgaattcgctctgtagagggcaggaagaaagccttctccacatgtggctcccacctcactgtggttgccatattctatggttcaggtatctttaactatatgcgactgggttcaaccaagctttcagacaaggataaagctgttggaattttcaacactgtcatcaatcccatgctgaacccaatcatctacagcttcagaaaccctgatgtgcagagtgccatctggaggatgctcacagggaggcggtcactggcttgaggaggtctcaattgaccctttctccctgtgtcttgtactaaaggaaaagtcttctagagccagaaactaggaaaaaaatggttcacacctgtttctgtttcatgggcataagaaggacttttggtagggaataatagtcctcatttctgaaagcagccctgtccaattattagcac

SEQ ID NO: 1414 - DNA, 1389 bp; single-stranded, linear
  immediate source library: GENBANK
  immediate source clone: g529236
ggagaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaacatccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgacgagccagctgcacaggaaaaaccaccagttacttgagtgtcactcagcaacactggtcacgtttggaaagaatatt

SEQ ID NO: 1415 - DNA, 2258 bp; single-stranded, linear
  immediate source library: GENBANK
  immediate source clone: g530089
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagaccatctggtatcatcttctcattttgcagaagagaaactgaggcccagaggcggagggcagtctgctcaaggtcacgcagctggtgactggttggggcagaccggacccaggtttcctgactcctggcccaagtctcttcctcctatcctgcgggatcactggggggctctcagggaacagcagcagtgccatagccaggctctctgctgcccagcgctggggtgaggctgccgttgtcagcgtggaccactaaccagcccgtcttctctctctgctcccacccctgccgcctcacctgcccttgttgtctctgtctctcactgtctcttctgctgtctctctactgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattc

SEQ ID NO: 1416 - DNA, 970 bp; single-stranded, linear
  immediate source library: GENBANK
  immediate source clone: g531102
ccctcaaagacagagacaccaagaagaatcggaacatacaggctttgatatcaaaggtttataaagccaatatctgggaaagagaaaaccgtgacttccagatcttctctggtgaagtgtgtttcctgcaacgatcacgaacatgaacatcaaaggatcgccatgaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatc

SEQ ID NO: 1417 - DNA, 1182 bp; single-stranded, linear
  immediate source library: GENBANK
  immediate source clone: g532059
tgcagcactcaccatggaatccccgattcagatcttccgcggggagcctggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcggttttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacag

SEQ ID NO: 1418 - DNA, 653 bp; single-stranded, linear
  immediate source library: GENBANK
  immediate source clone: g533212
acaggacacagctgggttctgaagcttctgagttctgcagcctcaccctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacacccgagaagcttcctcgaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggatggtccactgtcactgtttctctgctgttgcaaatacatggataacacatttgattcgtgtgtgttttcataataaaactttaaaataaaatgc

SEQ ID NO: 1419 - DNA, 2932 bp; single-stranded, linear
  immediate source library: GENBANK
  immediate source clone: g533325
gtaatgcagagataataaaacttcttaggtccataggtcttataataatttaataacctaaacatggtatacaaattcctccaaacccaataacataattatagtttcaaaaagttccccaaactttcaagttagattttattgctttgatgagtggctttaaatatgaaaagtcttgcctgtgaagggcaatccttttcccgtggactgggatctatagaaatacagaaatgtgcccaggggttcatctccctaataaccatcattcacatttctcaacctccctaataaccagccaccatgtgagaaggatccacagttactgtttatgactataattaactagtacctgggactggtcagtggagttggttgcaacctgatgctaaggatgtcaaagttgtctcggcctctgttcccagccagtaagtaattccctggcctcgggccataccccctaatcttggtcagctgattatgacaggcagacagcacagtaaataacactatatattaagaaaacccaaagcatatgtatcaatggtatatacccaacagcatcctaggaatggagagtctgtagcaagggcctccaatgtgaaggtcaacacagtcactgtgatgcgtgtatttccattttgtaaagcatgatctctggtggtcatttttatcttcctaacttattggaaaagtctcctgttttgggggcccgcccctggtcacagccagactgactcagtttccctgggaggtcccgctcgagcccgtccttcccctccctctgcccgcccccagccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcattgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccaggtcgctgtccctccagccccagctcacgcagcgctccgggctgcagtaggaagtggacagagcgcccctcccgcgcctttccgcggagcccttggcccctcggacagcccatctgcctgttctgaggattcaggggctgggggtgctggatggacagtgggcatcagcagcagggttttgggttgaccccaatccaacccggggacccccaactcctccctgatccttttaccaagcactctcccttcctcggcccctttttcccatccagagctcccaccccttctctgcgtccctcccaaccccaggaagggcatgcagacattggaagagggtcttgcattgctatttttttttttagacggagtcttgctctgtcccccaggctggagtgcagtggcgcaatctcagctcactgcaacctccacctcccgggttcaagcgattctcctgcctcagcctcctgagtagctgggactataggcgcgcgccaccacgcccggctaatttttgtatttttagtagagacggggtttcaccgtgttggccaggctggtcttgaactcctgacctcaggtgattcaccagcctcagcctcccaaagtgctgggatcacaggcatgaaccaccacacctggccattttttttttttttttagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaaacgggggcacccccttttcttgccaaaatatatctctgcctttggttttat

SEQ ID NO: 1420 - DNA, 1434 bp; single-stranded, linear
  immediate source library: GENBANK
  immediate source clone: g536775
caattcttgtccattgtctctacagattagtctatattatttgacttgtgtatcccactaagaatttaaaagaagcagaggtcaccatctccgagttcattctcatgtaactgaatgaaaacaatgagctgaaaataattctaagtttttttattgtttgacaggttcaacgttacagggtctgacaagtgtgtttttctgaaaaacacagaggtcagcagcatggaatgtgagaagaatttatactggatatgtaacaaaccttacaaataataaggaaacatgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactactggaaggagttagatgttggtactagatactgaatgtaaacaaaggaattatggctggtaacataggtttttagtctaattgaatcccttaaactcagggagcatttataaatggacaaatgcttatgaaactaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaatggtttccaagaaagttcattccttcaaaatacattaaaaagtatatactatatgagaaagcagaaaacagagttactataacttagaaaaaaatcccatgtagagtaaaacccttagttttataatagcttatacatatcaaattgttttcatatgcttatatgc

SEQ ID NO: 1421 - DNA, 1682 bp; single-stranded, linear
  immediate source library: GENBANK
  immediate source clone: g545303
agagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcatgaaagaaaacacttaacttgcatgtgcacagcttctggtaacaaatatcgctaaaccttactgtgaatttaggcatctctggcatgccactgtttatgcattgaagtggaatttttggtataaagctaaatggtcttagaagcatagaaaatccctatgtgccaaaagtagtgaaacacaaacaaaggaaaatatattaataacagtctagtgtttttgttgagtctgccattcgtagctgaatatgtgattaattatgtgatgaaaactttttttataaatgatcttggtctattgggg

SEQ ID NO: 1422 - DNA, 723 bp; single-stranded, linear
  immediate source library: GENBANK
  immediate source clone: g550059
gggcggcggtcggcagcaaggcggcggtgcgccgccgcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaacgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaatttgcctccatccttttctcacagcaatgaatttgcaatctgaacccaagtgaa

SEQ ID NO: 1423 - DNA, 1053 bp; single-stranded, linear
  immediate source library: GENBANK
  immediate source clone: g559047
atggagctggcggtcgggaacctcagcgagggcaacgcgagctgtccggagccccccgccccggagcccgggccgctgttcggcatcggcgtggagaacttcgtcacgctggtggtgttcggcctgatcttcgcgctgggcgtgctgggcaacagcctagtgatcaccgtgctggcgcgcagcaagccgggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtccttaatcacttgcataaaaagttgaagaacatgtcaaagaagtctgaagcatccaagaaaaagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaaataaaagtcgaatagacaccccaccatcaaccaattgtactcatgtgtgataa

SEQ ID NO: 1424 - DNA, 2457 bp; single-stranded, linear
  immediate source library: GENBANK
  immediate source clone: g560152
cacgcagcaggatggcaagggctccgcttggggtcctgctcctcttggggcttctcggcaggggtgtggggaagaacgaggaactgcgtctttatcaccatctcttcaacaactatgacccaggaagccggccagtgcgggagcctgaggatactgtcaccatcagcctcaaggtcaccctgacgaatctcatctcactgaatgaaaaagaggagactctcaccactagcgtctggattggaatcgattggcaggattaccgactcaactacagcaaggacgactttgggggtatagaaaccctgcgagtcccttcagaactcgtgtggctgccagagattgtgctggaaaacaatattgatggccagttcggagtggcctacgacgccaacgtgctcgtctacgagggcggctccgtgacgtggctgcctccggccatctaccgcagcgtctgcgcagtggaggtcacctacttccccttcgattggcagaactgttcgcttattttccgctctcagacgtacaatgccgaagaggtggagttcacttttgccgtagacaacgacggcaagaccatcaacaagatcgacatcgacacagaggcctatactgagaacggcgagtgggccatcgacttctgcccgggggtgatccgccgccaccacggtggcgccaccgacggcccaggggagactgacgtcatctactcgctcatcatccgccggaagccgctcttctacgtcattaacatcatcgtgccctgtgtgctcatctcgggcctggtgctgctcgcctacttcctgccggcgcaggccggcggccagaaatgcacggtctccatcaacgtcctgctcgcccagaccgtcttcttgttcctcattgcccagaaaatcccagagacttctctgagcgtgccgctcctgggcaggttccttattttcgtcatggtggtcgccacgctcattgtcatgaattgcgtcatcgtgctcaacgtgtcccagcggacgcccaccacccacgccatgtccccgcggctgcgccacgttctcctggagctgctgccgcgcctcctgggctccccgccgccgcccgaggccccccgggccgcctcgcccccaaggcgggcgtcgtcggtgggcttattgctccgcgcggaggagctgatactgaaaaagccacggagcgagctcgtgtttgaggggcagaggcaccggcaggggacctggacggctgccttctgccagagcctgggcgccgccgcccccgaggtccgctgctgtgtggatgccgtgaacttcgtggccgagagcacgagagatcaggaggccaccggcgaggaagtgtccgactgggtgcgcatggggaatgcccttgacaacatctgcttctgggccgctctggtgctcttcagcgtgggctccagcctcatcttcctcggggcctacttcaaccgagtgcctgatctcccctacgcgccgtgtatccagccttagctcgcaccgacttcaatttcccacccatctccagtaggaaattgattttgaaaaagtaggctgccgccaccacggcattatgatcccttccccctgctgatcaatctgcagtttgtgaacttcacaagaatggtgtgtgcccgttccctggcgtgtgtaggcctggccgcagtccaggggtcagcaggaggaaagggttcacataggctctcaggtgccagtcttccagaaagcaaggactgcccttcattcagccttgctgacctcccagcctttctaaggctcagccccacgggactctggtggctgccagcttgtgagctatctatctatattcatttcatagccaaacaggagacccctttgcaggacttgcacacagggaggctgtagccaggaaaccctcttcttccctggtctggctctgctggagcgggtgggaaccaaacaccttcagtgctggtggccctcaggcccacaggtttaaggctgaggctgccctgacccttccacagtcatttcttctaggttttcttggcccagcactgcccatcccaccccatgaggctcactcattgcagatcccagcccaccctgcccctttcttccccaccctggaggctctctctgcctagtctacagtactgacagaaagcaaggacatgcggcctgcatggtgggagctggttgaattgtctttattaacaaacaggatatccaaggccactacattgaggaggggggaggggggagggaggagaagggttacttgctgctcacactatatacagatgcaagcaaggggcgtggagagtgagggctccctgctccctccctccaccggggaagggcatgggctagaagaggagaggggggtcgggaatggggggaatgttttggctgcggggtcccccctccattccctggagtttgggggaaggggaatcattaaagtgctttcaga

SEQ ID NO: 1425 - DNA, 1824 bp; single-stranded, linear
  immediate source library: GENBANK
  immediate source clone: g563981
agcggaaagcctgctggtataagatggtcaattactttggtgcttgaagtcctctgaacgatttccgcctatttgcaagccttctccctgtcattctcaacgcttctcctttctctccacctcccctgccactccattttatccatcaaacctctccacttgcatccacaccctcccttcatccttccctcccagcaaaccttgctcatggattctgggcctctgtgggatgccaaccccacccctcggggcaccctctctgcccccaatgccacaacaccctggctgggccgggatgaggagctggccaaggtggagatcggagtcctggccactgtcctggtgctggcgaccgggggcaacctggctgtgctgctgaccctgggccagctgggccgcaagcgctcccgcatgcacctgttcgtgctgcacttagccctgacagacctggccgtggcgctcttccaggtgctgccacagctgctgtgggacatcacctaccgcttccagggccccgacctcctgtgcagggccgtcaagtacctgcaggtgctcagcatgtttgcctccacctacatgctgctggccatgacgctggaccgctacctggctgtctgtcaccccctgcgcagcctccagcagccaggccagtccacctacctgctcatcgctgctccctggctgctggccgccatcttcagcctccctcaagtcttcattttttccctgcgggaggtgatccagggctcaggggtgctggactgctgggcagacttcggcttcccttgggggccacgggcctacctcacctggaccaccctggctatcttcgttctgccggtgaccatgctcacggcctgctacagcctcatctgccatgagatctgtaaaaacctaaaagtcaagacacaggcctggcgggtgggaggagggggctggaggacttgggacaggccctcaccttccaccttagctgccaccactcgggggctgccatctcgggtcagcagcatcaacaccatctcacgggccaagatccgaacagtgaagatgacctttgtcatcgtgctggcctacatcgcttgctgggctcccttcttcagtgtccagatgtggtccgtgtgggacaagaatgcccctgatgaagattccaccaatgtggctttcaccatctctatgcttttgggcaacctcaacagctgctgcaacccctggatctacatgggcttcaacagccacctgttaccgcggcccctgcgtcaccttgcctgctgtgggggtccccagcccaggatgcgccggcggctctccgacggcagcctctcgagccgccacaccacgctgctgacccgctccagctgcccggccaccctcagcctcagcctcagcctaaccctcagtgggaggcccaggcctgaagagtcaccaagggacttggagctggcagatggggaaggcaccgctgagaccatcatcttttaggaaagactcgctggggtctggtactgcccccaggactagtggaggttctctgcccacctcgggcactggaaatgagagctgggagggtaagggttggagttagaggagccctgtctaaagcggagcgaaaaggccagaatgggtcccctaccctggtgtcacagctgcccctagtgtgagggctgcctcataagctcccaatctcagacactggcagtcagggagaatcaaactgcctgtctccctggtcctgccatattcatagggtgtccatgcacacatggtgtcccagatctaggcaggcctaggatggtgctgtcttaaggggtccacgggtggcag

SEQ ID NO: 1426 - DNA, 1438 bp; single-stranded, linear
  immediate source library: GENBANK
  immediate source clone: g577412
gggctgcagtgagccaaaagcatgccattgcactccagcttgggcaacagagtgagaccctgtctcaaaaaaaagaaaaaataatactatgtctggtccataacctgaaatatttttatcttcacgttccttatcattcactgaacttttatttttcttttaaaattttttcctttctttttaaatttgcttctacagatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggctcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgtgtctcatcttcaaggtgaagaagcgaacagtcctgatctccagtaggcatttctggacaattctggttgtggttgtggcctttgtggtttgctggactccttatcacctgtttagcatttgggagctcaccattcaccacaatagctattcccaccatgtgatgcaggctggaatccccctctccactggtttggcattcctcaatagttgcttgaaccccatcctttatgtcctaattagtaagaagttccaagctcgcttccggtcctcagttgctgagatactcaagtacacactgtgggaagtcagctgttctggcacagtgagtgaacagctcaggaactcagaaaccaagaatctgtgtctcctggaaacagctcaataagttattacttttccacaaatcagtatatggctttttatgtgggtcctctgactgatgctttcagattaaaattgtttccaagatagagagccgactccactttcatagttattgtttctggtcacatatatggcatcacatttt

SEQ ID NO: 1427 - DNA, 1382 bp; single-stranded, linear
  immediate source library: GENBANK
  immediate source clone: g577414
ctcggatccactagtaacggccgccagtgtgctggaattctgcagatatccatcacactggcggccgctcgagcatgcatctcagcttggaaggcaagtgtgggcgggggagttgtgtggtcagatgtgtctcataagatcccgcctctcatttgaccctcccaggtttcctggggccattactctggggatgaagaggacgcatactcggctgagccactgccggagctttgctacaaggccgatgtccaggccttcagccgggccttccaacccagtgtctccctgacgctggctgcgctgggtctggccggcaatggcctggtcctggccacccacctggcagcccgacgcgcagcgcgctcgcccacctctgcccacctgctccagctggccctggccgacctcttgctggccctgactctgcccttcgcggcagcaggggctcttcagggctggagtctgggaagtgccacctgccgcaccatctctggcctctactcggcctccttccacgccggcttcctcttcctggcctgtatcagcgccgaccgctacgtggccatcgcgcgagcgctcccagccgggccgcggccctccactcccggccgcgcacacttggtctccgtcatcgtgtggctgctgtcactgctcctggcgctgcctgcgctgctcttcagccaggatgggcagcgggaaggccaacgacgctgtcgcctcatcttccccgagggcctcacgcagacggtgaagggggcgagcgccgtggcgcaggtggccctgggcttcgcgctgccgctgggcgtcatggtagcctgctacgcgcttctgggccgcacgctgctggccgccagggggcccgagcgccggcgtgcgctgcgcgtcgtggtggctctggtggcggccttcgtggtgctgcagctgccctacagcctcgccctgctgctggatactgccgatctactggctgcgcgcgagcggagctgccctgccagcaaacgcaaggatgtcgcactgctggtgaccagcggcttggccctcgcccgctgtggcctcaatcccgttctctacgccttcctgggcctgcgcttccgccaggacctgcggaggctgctacggggtgggagctcgccctcagggcctcaaccccgccgcggctgcccccgccggccccgcctttcttcctgctcagctcccacggagacccacagtctctcctgggacaactagggctgcgaatctagagggccctattctatagtgtcacctaaatgctagagctcgctgatcagcctcgactgtgccttcatgttgccagccacttgttgtttgccctccccgtgccttccttgacctggaaggtgccactccactgtctttct

SEQ ID NO: 1428 - DNA, 1229 bp; single-stranded, linear
  immediate source library: GENBANK
  immediate source clone: g577631
aagcttctaaagatggaaaacgagacagtcagtgaactgaaccaaacacagcttcagccacgagcagtggtggccttagaataccaggtggtcaccatcttacttgtactcattatttgtggcctgggcattgtaggcaacatcatggtagtcctggttgtcatgagaaccaagcacatgaggacccccacaaactgctacctggtgagcctggcagtagctgatctcatggtcttggtggccgcaggcctccccaacataacagacagtatctacggttcctgggtctatggctatgttggatgcctctgcattacttacctccagtatttgggaattaatgcatcctcttgttcaataacagcctttaccattgagaggtacatagcaatctgtcaccccatcaaagcccagtttctctgcacattttccagagccaaaaagattatcatctttgtctgggctttcacatctctttactgtatgctctggttcttcttgctggatctcaatattagcacctacaaagatgctattgtgatatcctgtggctacaagatctccaggaattactactcacctatttacctaatggactttggtgtcttttatgttgtgccaatgatcctggctaccgtcctctatggattcatagctagaatccttttcttaaatcccattccttcagatcctaaagaaaactctaagacatggaaaaatgattcaacccatcagaacacaaatctgaatgtaaatacctctaatagatgtttcaacagcacagtatcttcaaggaagcaggtcaccaagatgctggcagtggttgtaattctgtttgcccttttatggatgccctacaggactctagtggttgtcaactcatttctctccagtcctttccaagaaaattggtttttgctcttttgcagaatttgcatttatctcaacagtgccatcaacccggtgatttacaatctcatgtcccagaaattccgtgcagccttcagaaagctctgcaactgcaagcagaagccaacagagaaacctgctaactacagtgtggccctaaattacagcgtcatcaaggagtcagaccatttcagcacagagcttgatgatatcactgtcactgacacttacctgtctgccacaaaagtgtcttttgatgacacctgcttggcttctgaggtatcctttagccaaagttgattcatgaattagaagaaaat

SEQ ID NO: 1429 - DNA, 1365 bp; single-stranded, linear
  immediate source library: GENBANK
  immediate source clone: g598152
ataattccatccctcctccaacttttccctctcaagctctgcccttcccagcccagcccagcctacccaacctcatctcttccctgtagaccacatcccaccatgttcccctgagcctccaaggaaggggctcaggggccccatggcctcccgctccctgtggccccacagcccccgtgggccaggggaagcgccccagaagccgaagtgcccaccatgggcaaccacacgtgggagggctgccacgtggactcgcgcgtggaccacctctttccgccatccctctacatctttgtcatcggcgtggggctgcccaccaactgcctggctctgtgggcggcctaccgccaggtgcaacagcgcaacgagctgggcgtctacctgatgaacctcagcatcgccgacctgctgtacatctgcacgctgccgctgtgggtggactacttcctgcaccacgacaactggatccacggccccgggtcctgcaagctctttgggttcatcttctacaccaatatctacatcagcatcgccttcctgtgctgcatctcggtggaccgctacctggctgtggcccacccactccgcttcgcccgcctgcgccgcgtcaagaccgccgtggccgtgagctccgtggtctgggccacggagctgggcgccaactcggcgcccctgttccatgacgagctcttccgagaccgctacaaccacaccttctgctttgagaagttccccatggaaggctgggtggcctggatgaacctctatcgggtgttcgtgggcttcctcttcccgtgggcgctcatgctgctgtcgtaccggggcatcctgcgggccgtgcggggcagcgtgtccaccgagcgccaggagaaggccaagatcaagcggctggccctcagcctcatcgccatcgtgctggtctgctttgcgccctatcacgtgctcttgctgtcccgcagcgccatctacctgggccgcccctgggactgcggcttcgaggagcgcgtcttttctgcataccacagctcactggctttcaccagcctcaactgtgtggcggaccccatcctctactgcctggtcaacgagggcgcccgcagcgatgtggccaaggccctgcacaacctgctccgctttctggccagcgacaagccccaggagatggccaatgcctcgctcaccctggagaccccactcacctccaagaggaacagcacagccaaagccatgactggcagctgggcggccactccgcctcccagggggaccaggtgcagctgaagatgctgccgccagcacaatgaaccccgagtggcacagaatccccagttttcccctctcatcccacagtcccttctctcctgg

SEQ ID NO: 1430 - DNA, 1265 bp; single-stranded, linear
  immediate source library: GENBANK
  immediate source clone: g598154
caaggcaatcctctccctttggcctttccaaagtgctaggattacaggtgttagccactgtacccagccaccacatggctttaaactccatgtctctatcatttcagatgctctaaacgtccctgccatctggtccagatggagtcctcaggcaacccagagagcaccacctttttttactatgaccttcagagccagccgtgtgagaaccaggcctgggtctttgctaccctcgccaccactgtcctgtactgcctggtgtttctcctcagcctagtgggcaacagcctggtcctgtgggtcctggtgaagtatgagagcctggagtccctcaccaacatcttcatcctcaacctgtgcctctcagacctggtgttcgcctgcttgttgcctgtgtggatctccccataccactggggctgggtgctgggagacttcctctgcaaactcctcaatatgatcttctccatcagcctctacagcagcatcttcttcctgaccatcatgaccatccaccgctacctgtcggtagtgagccccctctccaccctgcgcgtccccaccctccgctgccgggtgctggtgaccatggctgtgtgggtagccagcatcctgtcctccatcctcgacaccatcttccacaaggtgctttcttcgggctgtgattattccgaactcacgtggtacctcacctccgtctaccagcacaacctcttcttcctgctgtccctggggattatcctgttctgctacgtggagatcctcaggaccctgttccgctcacgctccaagcggcgccaccgcacggtcaagctcatcttcgccatcgtggtggcctacttcctcagctggggtccctacaacttcaccctgtttctgcagacgctgtttcggacccagatcatccggagctgcgaggccaaacagcagctagaatacgccctgctcatctgccgcaacctcgccttctcccactgctgctttaacccggtgctctatgtcttcgtgggggtcaagttccgcacacacctgaaacatgttctccggcagttctggttctgccggctgcaggcacccagcccagcctcgatcccccactcccctggtgccttcgcctatgagggcgcctccttctactgaggggcctgtggcggtgcaggcgcaggtgcaggtggacagggactggaatgggggtcatggagaagcgggcctggaaggagcattgcagaacacagcagggtggagacgtctcctcctgctgcagg

SEQ ID NO: 1431 - DNA, 1477 bp; single-stranded, linear
  immediate source library: GENBANK
  immediate source clone: g598156
ggcattcactcactcactcaacaggtatttattttgggttcgcacttaacccatgattccccgatttgctctggggtcccagggtggggtgggcaactcaagtggggcaatgcgagaggaggctctacgcgtggggaagtttcctggcagcctgaagtgtacacctgacgcctgcactccctccctatgcagggtgcaaatccggccgcgatgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccatctattgcgtggtgggcagccatgaggacccggcggtctacacttacgccaccctgctgcccgccacctacaactccatgatcaatcccatcatctatgccttccgcaaccaggagatccagcgcgccctgtggctcctgctctgtggctgtttccagtccaaagtgccctttcgttccaggtctcccagcgaggtctgaagggctcgccccgtgtcctctcaccaacaccacaccccaacaagccagcctttggtaagctcggtgcctgctgacgaactctgagatcccaatggtgtgagtctgactttggaaagaaaagggactaaagagaatgtaacaacttacaggacaaagaggcttgttggcacttacatat

SEQ ID NO: 1432 - DNA, 3234 bp; single-stranded, linear
  immediate source library: GENBANK
  immediate source clone: g599819
atggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtggtttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccctcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccttcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacaccagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattca

SEQ ID NO: 1433 - DNA, 1636 bp; single-stranded, linear
  immediate source library: GENBANK
  immediate source clone: g599826
ttgatagctctttctcgattccgtgggtggtggtgcatggccgttcttagttggtggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggccttcccacgtgctaggcagatgaacatcgatgtcgccacgtgggtgcggctgctccggaggctcatccccaatgccacgggcacaggcacctttagccctgggggttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatcctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccactcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacatcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaa

SEQ ID NO: 1434 - DNA, 4000 bp; single-stranded, linear
  immediate source library: GENBANK
  immediate source clone: g599833
gcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagactccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatgcttattaaaccttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagatcagaagacgtctccccttctctgcctcacctggtcgccaatccatgctctctttcttttctctgtctactccttatcccttggtttagaggaacccaagatgtggcctttagcaaaactgacaatgtccaaacccactcatgactgcatgacggagccgagcatgtgtctttacacctcgctgttgtcacatctcagggaactgaccctcaggcacaccttgcagaaggaaggccctgccctgcccaacctctgtggtcacccatgcatcattccactggaacgtttcactgcaaacacaccttggagaagtggcatcagtcaacagagaggggcagggaaggagacaccaagctcacccttcgtcatggaccgaggttcccactctggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaacaaaaaaa

SEQ ID NO: 1435 - DNA, 1085 bp; single-stranded, linear
  immediate source library: GENBANK
  immediate source clone: g602129
atggccctgcggccgggacgcgaacagggaccatgcagggcaacggcagcgcgctgcccaacgcctcccagcccgtgctccgcggggacggcgcgcggccctcgtggctggcgtccgccctagcctgcgtcctcatcttcaccatcgtggtggacatcctgggcaacctcctggtcatcctgtcggtgtatcggaacaagaagctcaggaacgcaggaaacatctttgtggtgagcttagcggtggcagacctggtggtggccatttatccgtacccgttggtgctgatgtcgatatttaacaacgggtggaacctgggctatctgcactgccaagtcagtgggttcctgatgggcctgagcgtcatcggctccatattcaacatcaccggcatcgccatcaaccgctactgctacatctgccacagtctcaagtacgacaaactgtacagcagcaagaactccctctgctacgtgctcctcatatggctcctgacgctggcggccgtcctgcccaacctccgtgcagggactctccagtacgacccgaggatctactcgtgcaccttcgcccagtccgtcagctccgcctacaccatcgccgtggtggttttccacttcctcgtccccatgatcatagtcatcttctgttacctgagaatatggatcctggttctccaggtcagacagagggtgaaacctgaccgcaaacccaaactgaaaccacaggacttcaggaattttgtcaccatgtttgtggtttttgtcctctttgccatttgctgggctcctctgaacttcattggcctggccgtggcctctgaccccgccagcatggtgcctaggatcccagagtggctgtttgtggccagttactacatggcgtatttcaacagctgcctcaatgccattatatacgggctactgaaccaaaatttcaggaaggaatacaggagaattatagtctcgctctgtacagccagggtgttctttgtggacagctctaacgacgtggccgatagggttaaatggaaaccgtctccactgatgaccaacaataatgtagtaaaggtggactccgtttaa

SEQ ID NO: 1436 - DNA, 1230 bp; single-stranded, linear
  immediate source library: GENBANK
  immediate source clone: g604499
aagcttgtggcatttggtactggtatctgagcaggggctggctttctgtttgtctgtgtgttttttgcatgatcttggattgtcaccctgctgtatttaaacattaaaaagcctgtcttttcgttgaagaggacaggggttaaaatgaatgaagacctgaaggtcaatttaagcgggctgcctcgggattatttagatgccgctgctgcggagaacatctcggctgctgtctcctcccgggttcctgccgtagagccagagcctgagctcgtagtcaacccctgggacattgtcttgtgtacctcgggaaccctcatctcctgtgaaaatgccattgtggtccttatcatcttccacaaccccagcctgcgagcacccatgttcctgctaataggcagcctggctcttgcagacctgctggccggcattggactcatcaccaattttgtttttgcctacctgcttcagtcagaagccaccaagctggtcacgatcggcctcattgtcgcctctttctctgcctctgtctgcagcttgctggctatcactgttgaccgctacctctcactgtactacgctctgacgtaccattcggagaggacggtcacgtttacctatgtcatgctcgtcatgctctgggggacctccatctgcctggggctgctgcccgtcatgggctggaactgcctccgagacgagtccacctgcagcgtggtcagaccgctcaccaagaacaacgcggccatcctctcggtgtccttcctcttcatgtttgcgctcatgcttcagctctacatccagatctgtaagattgtgatgaggcacgcccatcagatagccctgcagcaccacttcctggccacgtcgcactatgtgaccacccggaaaggggtctccaccctggctatcatcctggggacgtttgctgcttgctggatgcctttcaccctctattccttgatagcggattacacctacccctccatctatacctacgccaccctcctgcccgccacctacaattccatcatcaaccctgtcatatatgctttcagaaaccaagagatccagaaagcgctctgtctcatttgctgcggctgcatcccgtccagtctcgcccagagagcgcgctcgcccagtgatgtgtagcacccttgcacccaggaggactctgcatttaccaagcacttccactgcctggccaaggtttgagatgcttcccttgaattc

SEQ ID NO: 1437 - DNA, 1873 bp; single-stranded, linear
  immediate source library: GENBANK
  immediate source clone: g607785
caaactacgtgctgtacagctgcatcagctgctcgtagacatgtccagcagctggtcgaggtccacgccgcggtaggtgaagttgcggaaggtccggcgagggatctgaaacttgccccttacccttcgggatattgcaggacgctgcatcatgagcgacagtaaatgtgacagtcagttttatagtgtccaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagcctccagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcagttgagcagttagagtaggtgaatttgtcaaattgtactagtgacagtttctcatcatctgtaactgttgagatgattgtgcatgtgaccacaaatgcttgcttggacttgcccatctagcactttggaaatcagtatttaaatgccaaataatcttccaggtagtgctgcttctgaagttatctcttaatcctcttaagtaatttgg

SEQ ID NO: 1438 - DNA, 1790 bp; single-stranded, linear
  immediate source library: GENBANK
  immediate source clone: g624627
gggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaata

SEQ ID NO: 1439 - DNA, 1762 bp; single-stranded, linear
  immediate source library: GENBANK
  immediate source clone: g632971
tggggcactggtacctccaggacctggagtgtactggaagaaatggtgcagtccagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcacaggccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaacctgagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgta

SEQ ID NO: 1440 - DNA, 1161 bp; single-stranded, linear
  immediate source library: GENBANK
  immediate source clone: g632973
gaattccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccacgtacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatgggatctgcctagcctgggctggagtccttgctttgctgctgctgagctgccgggcaacctcagatgaccgacttttccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggtgggtagcttgaggccaggagctcgaaaccagtccgggccacacagcaagaccccatctctaaaaaattaatataaatataaaataaaaaaaaaaaaaaggaattc

SEQ ID NO: 1441 - DNA, 2372 bp; single-stranded, linear
  immediate source library: GENBANK
  immediate source clone: g639719
gggccgccgtcggcgcgctgggtgcgggaagggggctctggatttcggtccctcccctttttcctctgagtctcggaacgctccagctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcggcctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccctggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcaatgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactcttattatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttaggggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaaca

SEQ ID NO: 1442 - DNA, 3100 bp; single-stranded, linear
  immediate source library: GENBANK
  immediate source clone: g665580
actcgtctctggtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctgcactgctgtgctgtgcccaagttgtggtgctgacaaagcttggaagagcctgcaggtgccttggccgcgtgcatagcccagacacagaagaggctggttcttacgatggcacccagtgagcactcccaagtctacagagtgatagccttccgtaacccaactctcctggactgccttgaatatcccctcccagtcaccttgtgcaagcccctgcccatctgggaaaataccccatcattcatgctactgccaacctggggagccagggctatgggagcagcttttttttcccccctagaaacgtttggaacaatgtaaaactttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttc

SEQ ID NO: 1443 - DNA, 2202 bp; single-stranded, linear
  immediate source library: GENBANK
  immediate source clone: g681913
ggaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgccctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccc

SEQ ID NO: 1444 - DNA, 2030 bp; single-stranded, linear
  immediate source library: GENBANK
  immediate source clone: g685173
tggctggcaatggccttgctgacctcgagccgggcccacgtggggacctttggagcacagcctacgatcctggtgcaaggccggtggatgcagaggccagtccatataccacccaggcctgcgaggagcgtggtccccacccatccagcccatatgtgcaagtgcccttgacagagaggctggtcatatccatggtgaccatttatgggccacaacaggtccccatctgcgcagtgaaccctgtgctgagcaccttgcagacgtgatcttgcttcgtcctgcagcactgtgcggggcaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaagaagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggg

SEQ ID NO: 1445 - DNA, 3576 bp; single-stranded, linear
  immediate source library: GENBANK
  immediate source clone: g685175
ctcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatatctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctctaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccgaggatttttaacccccaatctctcataatcgctagtgtttaaaaggctaagaatagtggggcccaaccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctggctgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgttt

SEQ ID NO: 1446 - DNA, 1317 bp; single-stranded, linear
  immediate source library: GENBANK
  immediate source clone: g693907
gcagcgctagctccgccgcgctcagctgccctgcgccggcacccctggtcatgagcgccccctcgacgctgccccccgggggcgaggaagggctggggacggcctggccctctgcagccaatgccagtagcgctccggcggaggcggaggaggcggtggcggggcccggggacgcgcgggcggcgggcatggtcgctatccagtgcatctacgcgctggtgtgcctggtggggctggtgggcaacgccctggtcatcttcgtgatccttcgctacgccaagatgaagacggctaccaacatctacctgctcaacctggccgtagccgacgagctcttcatgctgagcgtgcccttcgtggcctcgtcggccgccctgcgccactggcccttcggctccgtgctgtgccgcgcggtgctcagcgtcgacggcctcaacatgttcaccagcgtcttctgtctcaccgtgctcagcgtggaccgctacgtggccgtggtgcaccctctgcgcgcggcgacctaccggcggcccagcgtggccaagctcatcaacctgggcgtgtggctggcatccctgttggtcactctccccatcgccatcttcgcagacaccagaccggctcgcggcggccaggccgtggcctgcaacctgcagtggccacacccggcctggtcggcagtcttcgtggtctacactttcctgctgggcttcctgctgcccgtgctggccattggcctgtgctacctgctcatcgtgggcaagatgcgcgccgtggccctgcgcgctggctggcagcagcgcaggcgctcggagaagaaaatcaccaggctggtgctgatggtcgtggtcgtctttgtgctctgctggatgcctttctacgtggtgcagctgctgaacctcgtcgtgaccagccttgatgccaccgtcaaccacgtgtcccttatcctcagctatgccaacagctgcgccaaccctattctctatggcttcctctccgacaacttccgccgatccttccagcgggttctctgcctgcgctgctgcctcctggaaggtgctggaggtgctgaggaggagcccctggactactatgccactgctctcaagagcaaaggtggggcagggtgcatgtgccccccactcccctgccagcaggaagccctgcaaccagaacccggccgcaagcgcatccccctcaccaggaccaccaccttctgaggagcccttcccctacccaccctgcgtggccacctcccaaggggtgggcaccattcctacagccccgaagactgcatctcctgaatgctcacctaagctc

SEQ ID NO: 1447 - DNA, 1317 bp; single-stranded, linear
  immediate source library: GENBANK
  immediate source clone: g712836
atgcggacgctgctgcctcccgcgctgctgacctgctggctgctcgcccccgtgaacagcattcacccagaatgccgatttcatctggaaatacaggaggaagaaacaaaatgtacagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccacaacggctcggagggcgccctgcagttccaccgcgcgtcccgagcccagtccttcctgcaaacggagacctcggtcatctag

SEQ ID NO: 1448 - DNA, 1528 bp; single-stranded, linear
  immediate source library: GENBANK
  immediate source clone: g726512
cagtgccttggtaatgaccagggctccagaaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccaggcgttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtggagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 1449 - DNA, 4079 bp; single-stranded, linear
  immediate source library: GENBANK
  immediate source clone: g727358
tagagtttgatcacttgatcacttctcaccacctgccctgctactctccccagctgtcacccgccagcatgtttatttagtgtgtgtattgtttatcaacttcttcctcctgctaggcttatacgcacactgagagcagggatttttgcctgctgtattcactgctttgtcctaaatacctagaacagtgcctggcacatagtacattctcagtaaatacttgttcagcaaataaataactggaggaaccagtgaattataccccggtgtgaataactccatgtgagtgacatgacagaatgtcagagctagaagggcctcttgaggacatcatgtcttccttagatgaggaaagtcaggctcagagacatgaactgactctcctgaggtacacagccaaatatgctcttccaaggttaattctctgctacacaatagcttttgttggtatctgtgaggctttgcggggttgaaggaatctcaggtgtcacccattaataacaatcatgacagtgacaactaatgtttgccacgtgcttacaataagtcaggaaccctgccaagcaccgggcgtatattaacctatccaagctggggaagaatgtttaggctctgaagattgtctggagccgcataaatcccgcagtgtaggcagctgctcattctgcagatagtattctgtggatccctgagttggctgtggccggttttgccagcaggaggccacgaagccatgagcacaggatgggatctaccccttgtgggatcgcagagggctgggagatgcagtcctccctatggaaagagacagagctttctatccctctcccggtgaaactcagcatgggagcatgggaggcaggtcagctgcgtggctatgaacatgagctatggggtgcatgcagaccaaggttcatagtgtacactgtacccaccagctgtagctcctccagcaagcgtgggaggccagtcagctgcatggctgtgagcacggcctctggggtccatgcagaccaaggttcctggcgtagcactgtaaccaccacctaggtcttctccgacaagctggttaacttctctgagcctggctttgtcattcatcgcgtggggacaggtgcagcagaagagagcagacagaagcacaggatctcaatcaggctcttgaatcagactgcctgggtttgaatccaggccctactgaccagctgtgtgacctcagacaggcgactccgggtctaagcactcaattttctaattggccaactggagatgacaatggcccctaccttgaatggctgccaggaagattaaatgagaaaatacttaaatgtgaaacacttagaatggcgcctggaacacagaccattaataccatctaacagatgttagttgttaaccttatttattactcatgctttcctttctcttttttcttttctctctctctctctccttttttttttttttttttgttgttgttgttgttgttgagacagggtctcagtccgtcggcccagactgaagtgcagtggcacaatcatagctcgctgcagcctcgaccttccaggcttaaacgattctcccacctcagcctctcgagttgctgggaccacaggtatgcaccaccatgcccagctaatttttgtattttttgtaaagacaggatttcaccatgttgcccaggctggtcttgaactcctgggttcatctgatccatctgccttggcctcccaaagtactgagattacaggtgtgaaccaccacacccggccaatactcatgtttttcaagcctgtaagaggaacttcctaggactgtccccaccccggccaccacactggtcccagccccaacaggtcagcttcctttgctgttcccgggcttccctcagctctatctcaagccatgacctctgcctccatgtctgcagccccatgaggctggggctgctctgtcctgcatatctccagtgcctggcaaggggctggcaagaggtagaggctcattaaatgcctgttaaaaccctaatagtaataataataatggtacagttgttactaagactaatcactaccttccaaagtctttcctctatgcaaggcacggagctaagcaccctgtagatcctgacaacagccctcccgtgatcccacaagagagacacgattctctccaatgtttaaaaaggaaagtaaaagtcaatggttctaagtagctcacactgagtgattgtaccgggatttggactcaggcaccatcccttaaaccagaggtcagcaaacttttccccctcaggaacagatggtaaatatcttcactttgcaagccagacagtctctgttacaagcgctcgactcccccttgtagcatgaacacagctgtagataatacgtccaggaatgggtgtggctctgtgccaataaaactttattgtccaaaaacaggtgacaggttggtttggctcataggctgtagtctgccacttcctgttttattctaccttctgttcatttcaggtcactgtgcatggcatcatcctggccccctctagagctccaatcctccaaccagagccagctcttccctcaaaatgctacggcctgtgacaatgctccagaagcctgggacctgctgcacagagtgctgccgacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagcggaaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaagagtgcgggggccgaaggatagaaagaccacagcgctgatcctcacgctcgtggttgcctccctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaaaacagcattgaaccaagaagcttggctttcttatcaattctttgtgacataataaatgctattgtgataggctaaatgattactcccgtagattggggggtacctaatccctggacttgatgaatgttaccaaattaagggtcttgagatggggagatgatcctgaattatccaagtgggccctatataatcacaagggtccttataggagggaggcaggaggctcagagtcaggagatgtgactatggaagcagaggccagaggaattcaggacggccactacgagccaaggattgcaggcaccctctagaggctgtaaagggcaaggaaatggcttctcccctggagcctccagaaggaatgggtcctgccaactccctgtcttcagcccagggaaacagatttaggatttctggcctccagaactgttagaggatacatttgtgttttgttttgctttgtttgctttgctttgctttgctttgctttt

SEQ ID NO: 1450 - DNA, 2135 bp; single-stranded, linear
  immediate source library: GENBANK
  immediate source clone: g736236
tcggcttatttgttttccctcctcttaggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacagtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagccaaactgaaaggtagacttttatgagaacaatggacaagcagtggatacgtgtcaatgtgtgcactttttttctatattattgcccatgatataactttagaaataaaccttaatatttcttcccaaaaaaaaaaa

SEQ ID NO: 1451 - DNA, 1616 bp; single-stranded, linear
  immediate source library: GENBANK
  immediate source clone: g763533
gagttagaaagcaggataaagtcggtattctcggggaacgtgcgggcaccatgcgtccccacctgtcgccgccgctgcagcagctactactgccggtgctgctcgcctgcgccgcgcactcgactggagcccttccccgactatgtgacgtgctacaagtgctgtgggaagagcaagaccagtgcctgcaggaactctccagagagcagacaggagacctgggcacggagcagccagtgccaggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatgcccacagggcgggctgcaagctggtcatggtgctgttccagtactgcatcatggccaactactcctggctgctggtggaaggcctctaccttcacacactcctcgccatctccttcttctctgaaagaaagtacctccagggatttgtggcattcggatggggttctccagccatttttgttgctttgtgggctattgccagacactttctggaagatgttgggtgctgggacatcaatgccaacgcatccatctggtggatcattcgtggtcctgtgatcctctccatcctgtttaatttcatccttttcataaacattctaagaatcctgatgagaaaacttagaacccaagaaacaagaggaaatcaagtcagccattataagcgcctggccaggtccactctcctgctgatccccctctttggcatccactacatcgtcttcgccttctccccagaggacgctatggagatccagctgttttttgaactagcccttggctcattccagggactggtggtggccgtcctctactgcttcctcaatggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctgagaggctggagcagggtcacccacggacagagaccaagagaggtcctgcgaaggctgggcactgctgtgggacagccagtcttcccagcagacaccctgtgtcctccttcagctgaagatgcccctccccaggccttggactcttccgaagggatgtgaggcactgtggggcaggacaagggcctgggatttggttcgtttgctcttctgggaagagaagttcaggggtcccagaaagggacag

SEQ ID NO: 1452 - DNA, 2129 bp; single-stranded, linear
  immediate source library: GENBANK
  immediate source clone: g775207
ggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtcccccgacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaagtaaggagactggggaggggggctgggcaagggaacagaccagtgacgtgaagacatctggctcaggaccgctgatctgtgtttggcctgcagattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacattggccatgcacatatggactctgcacatgaatcccacccacatgtgacacatatgcaccttgtgtctgtacacgtgtcctgtagtgttgcggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgccg

SEQ ID NO: 1453 - DNA, 3149 bp; single-stranded, linear
  immediate source library: GENBANK
  immediate source clone: g784993
ctaaagtttttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacggtggacagttactattgcacttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagggtctgccctgagcattctgactgtgtcaactccatgggaagctacagttgcagctgtcaagttggattcatctctagaaactccacctgtgaagacgtgaatgaatgtgcagatccaagagcttgcccagagcatgcaacttgtaataacactgttggaaactactcttgtttctgcaacccaggatttgaatccagcagtggccacttgagttgccagggtctcaaagcatcgtgtgaagatattgatgaatgcactgaaatgtgccccatcaattcaacatgcaccaacactcctgggagctacttttgcacctgccaccctggctttgcaccaagcagtggacagttgaatttcacagaccaaggagtggaatgtagagatattgatgagtgccgccaagatccatcaacctgtggtcctaattctatctgcaccaatgccctgggctcctacagctgtggctgcattgtaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccatgtggactaaattcaccaaggaagagacgtcctccctggccacagtcttcctggagagtgtggaaagcatgacactggcatctttttggaaaccctcagcaaatgtcactccggctgttcgggcggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttccaagaccaccaggctcccttgaccacctctgagatcaagctgaagatgaattctcgagtcgttgggggcataatgactggagagaagaaagacggcttctcagatccaatcatctacactctggagaacgttcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagacgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggccgtcttcctgtggttgtatgcactgatgagaaatcagacgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcgtgcccctccagcgcctatcatacgcctgacacagagaacctctcaataaatgatttgtcgcctgtctgactgatttaccctaaaaaaaaaaaaaaaaaaaaaaaaaaaaaaa

SEQ ID NO: 1454 - DNA, 1480 bp; single-stranded, linear
  immediate source library: GENBANK
  immediate source clone: g790789
gaattccgagcaagagcgcgggcgggtggcccaggcacgcagcgggtgaggaccgcgcccacagctcggcgccaaccaccgcgggcctcccagccagccccgcnnngagccgcagganccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggccagcctgctccccttccctccctgaaccgggagtttctctgccctgtcccctcctcacctgcttccctaccactcctcactgcattttccatacaaatgtttctattttattgttccttcttgtaataaagggaagataaaaccaaaaaaaaaaaaaaaaaaacggaattcc

SEQ ID NO: 1455 - DNA, 1155 bp; single-stranded, linear
  immediate source library: GENBANK
  immediate source clone: g791046
gcaaaagaattccgggcccggctgtatttgtacttgagcttggagaggctggtggtgacagaggagggagacaggcaggcaggtgagggaagcagcggtctctgacgccggctttattataagcatgaggtggcacgaggcaggagttggcgatgccacctgggggtcacattgagtctggagcttccttcagcccaagcgctggcagtgacggggacaaaggtctaaagcccagggaagaaggggaggcgccagaggcagggccatgcttggcttcccagctggccccagtgcagtgggtggcaccgccgaggctgctgttacggctcatcttcattgatttgcctgcgcttcttattgcccccacagcggaatcttctgctgaggaggatgaggagccccacgatgaaggccagtccagcgaagatcaggcccccattgcgaacggtctcatagtcatagtagaacgggtccacgtcccccttggggctgccgccaccgtccatcgacaacccagtcatttccccaggtgaatgggctgcctccactcccctcttcctgcaagaagttctcaagcctttttgatttttgtgcaataaagtacagctttgcataagagtgaaattgggctagcttaaatggatccataaactttcttctaattttaagtgagaatcttttaaacacctgttaaatttaatgtagcagtctgagaatctaaaattatgtaccactcgtttatttgttcattcatccatcccttttcccatgaatatttcatttgtttatccagctagttttattaactgttttaatccaggcattgggatataatgataagcaagatatcattcctgtggaaacttcttccaggcactaaagatatagaggatgaattagaggaacataaaattggaggagattgaatacttaaaggcagtggccatagggatggcaaagaggaagtagagatagagtcattaggacttagtgccaattaaatacggggtgagtgagagaagatggctttgggatgtcctcaagttcctagcttatttattcattatgcttttattggaggactatcatgttttaggcattgttatgtttcaggcattgccggaattcagcttggacttaaccaggctgaactgg

SEQ ID NO: 1456 - DNA, 3055 bp; single-stranded, linear
  immediate source library: GENBANK
  immediate source clone: g798835
gaattccgttgctgtcggcggagacctgctccccagaagacgcctcctgcttcccactgcgccctggaggacgcgggctggctgctgggcgagctcggcggaggcacgcccctcgcctccccgcggagtgcggactcgccccggtgcccaaactccgcccaccctctagggagctccgctctcccgcctaaccccggcactccggacagagctgggcctggggaaggggttcctgaactacgcggacgccgaacgggacgcgctgcagaagcgcacgagtctgcggccacgcgcgctccgatggctgccaggagctgagctcagggtgggcggaggaagcggttagacgccccgaaactgagctgcacgtttctaaggtagggaggaggaagatgcccccaattaagttgatctttgagccaaggaggctggggagcagcctccccaagctagagccctgcagagcgagtttcccttgacctcgctgcgcctctggcggctctgcagcgcggacccgcggcccctcgggaaagcgcagtcggaaagttatccgcggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagttttactacctgccggctgtctacatcttggtattcatcatcggcttcctgggcaacagcgtggccatctggatgttcgtcttccacatgaagccctggagcggcatctccgtgtacatgttcaatttggctctggccgacttcttgtacgtgctgactctgccagccctgatcttctactacttcaataaaacagactggatcttcggggatgccatgtgtaaactgcagaggttcatctttcatgtgaacctctatggcatcttgtttctgacatgcatcagtgcccaccggtacagcggtgtggtgtaccccctcaagtccctgggccggctcaaaaagaagaatgcgatctgtatcagcgtgctggtgtggctcattgtggtggtggcgatctcccccatcctcttctactcaggtaccggggtccgcaaaaacaaaaccatcacctgttacgacaccacctcagacgagtacctgcgaagttatttcatctacagcatgtgcacgaccgtggccatgttctgtgtccccttggtgctgattctgggctgttacggattaattgtgagagctttgatttacaaagatctggacaactctcctctgaggagaaaatcgatttacctggtaatcattgtactgactgtttttgctgtgtcttacatccctttccatgtgatgaaaacgatgaacttgagggcccggcttgattttcagaccccagcaatgtgtgctttcaatgacagggtttatgccacgtatcaggtgacaagaggtctagcaagtctcaacagttgtgtggaccccattctctatttcttggcgggagatactttcagaaggagactctcccgagccacaaggaaagcttctagaagaagtgaggcaaatttgcaatccaagagtgaagacatgaccctcaatattttacctgagttcaagcagaatggagatacaagcctgtgaaggcacaagaatctccaaacacctctctgttgtaatatggtaggatgcttaacagaatcaagtacttttcccctctttaactttctagtttagaaaaaaatcaaaccaagaaaatagtgagttaaaaaaataatagaagtagaaatgcccacatccacacttagcttgtttgggtttgctttcacagtctctcttccttctgactagaagtatgtataataaaacaatactacctagttaaacatttactttctcttttgcctttaaaatgtgcaggcttttctgtttaaagtgtgtgtgcacatgagtactggggctgtttttgatattagtaatttctctaagaaaactagccccctgcaacttgagtttgtggtttatctagcctttattgtttttttaaaatccacagtaggaataaaaaatctatattctcagaaatatctagcatggtatataacaaaacactaaactcatcagttcatccggcatcagatcaatggatctctgagcggggtgtttttttcagtgtcttataagcatagatgatagttgactgagtttctttagggcattgaatagacaagtaaagctaatgaatttaaaagcctgaaaagtgattgttttccagttatttctggaaaaggtctcattatatattgggtgctaaatgtttgatggggaaagcctgcatatattatcgtactggtaaaatgcattcaaaataattaaagtgcatgtattttccttgtaaacaccatgagctctcttagacatcttgtgataaagagcatttacttgccccactgctgtgcaatgccttaggactttgtttgtgttccaggacaagtgttcactcacatctgtaaaaacaattttaagaattgcaaataaattacagaccaaagattgagtaaagtcaaataactgttagtaagttgaaggatattggacaggaggacagtatttcagaaaaggagaggttgacagtcatccacaaggcatagcctccaagtatactctcaaatgtatgaagcaactggggtgggcagaagacattttagaatgagcgacagcaacggaattc

SEQ ID NO: 1457 - DNA, 2107 bp; single-stranded, linear
  immediate source library: GENBANK
  immediate source clone: g829176
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgtttt

SEQ ID NO: 1458 - DNA, 2828 bp; single-stranded, linear
  immediate source library: GENBANK
  immediate source clone: g837260
gaattccggagacccccgcgctggggacgggaggccggcgagcctcgggacctctgaaagccttgaggaggcccggggacaccatggccgagcctctgaaggaggaagacggcgaggacggctctgcggagcccccggcccgtgaaggtcgaacccgcccacaccgctgcctctgtagcgccaagaacctggccctgcttaaagcccgctccttcgatgtgacctttgacgtgggcgacgagtacgagatcatcgagaccataggcaacggggcctatggagtggtgtcctccgcccgccgccgcctcaccggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctctagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtcttttgccatcaaaatgaggcctgtgaaatacaaggtt

SEQ ID NO: 1459 - DNA, 2921 bp; single-stranded, linear
  immediate source library: GENBANK
  immediate source clone: g840770
agcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgaggtctgccaggtgctgggcagcaagaacggcagcaccacctgccaatgcagccacctgagcagctttacgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaaaaaaa

SEQ ID NO: 1460 - DNA, 1143 bp; single-stranded, linear
  immediate source library: GENBANK
  immediate source clone: g841307
ccggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcgat

SEQ ID NO: 1461 - DNA, 1331 bp; single-stranded, linear
  immediate source library: GENBANK
  immediate source clone: g852056
gaattccgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctggaattc

SEQ ID NO: 1462 - DNA, 419 bp; single-stranded, linear
  immediate source library: GENBANK
  immediate source clone: g871884
ctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggatcgggaaaaaattcggcctcctgaaatgacagcagggagacttgggtcggcctcctgaaatgatagcagggagacttgggtgaccccccttccaggcgccatctagcacagcctggccctgatctccgggcagccaccacctcctcggtctgccccctcattaaaattcacgttcccaccctgaaa

SEQ ID NO: 1463 - DNA, 2641 bp; single-stranded, linear
  immediate source library: GENBANK
  immediate source clone: g887966
ggccggtggcccgggcccgaccaccccagctgcgcgtcgttactggccacaagtttgctctgggccagccaagttggcaacttggaagcttctcccgggctctggaggagggtccctgcttcttcctacagccgttccgggcatggccgggctgggggcgtcgctccacgtctggggttggctaatgctcggcagctgcctcctggccagagcccagctggattctgatggcaccattactatagaggagcagattgtccttgtgctgaaagcgaaagtacaatgtgaactcaacatcacagctcaactccaggagggagaaggtaattgtttccctgaatgggatggactcatttgttggcccagaggaacagtggggaaaatatcggctgttccatgccctccttatatttatgacttcaaccataaaggagttgctttccgacactgtaaccccaatggaacatgggattttatgcacagcttaaataaaacatgggccaattattcagactgccttcgctttctgcagccagatatcagcataggaaagcaagaattctttgaacgcctctatgtaatgtataccgttggctactccatctcttttggttccttggctgtggctattctcatcattggttacttcagacgattgcattgcactaggaactatatccacatgcacttatttgtgtctttcatgctgagagctacaagcatctttgtcaaagacagagtagtccatgctcacataggagtaaaggagctggagtccctaataatgcaggatgacccacaaaattccattgaggcaacttctgtggacaaatcacaatatatcgggtgcaagattgctgttgtgatgtttatttacttcctggctacaaattattattggatcctggtggaaggtctctacctgcataatctcatctttgtggctttcttttcggacaccaaatacctgtggggcttcatcttgataggctgggggtttccagcagcatttgttgcagcatgggctgtggcacgagcaactctggctgatgcgaggtgctgggaacttagtgctggagacatcaagtggatttatcaagcaccgatcttagcagctattgggctgaattttattctgtttctgaatacggttagagttctagctaccaaaatctgggagaccaatgcagttgggcatgacacaaggaagcaatacaggaaactggccaaatcgacactggtcctggtcctagtctttggagtgcattacatcgtgttcgtatgcctgcctcactccttcactgggctcgggtgggagatccgcatgcactgtgagctcttcttcaactcctttcagggtttctttgtgtctatcatctactgctactgcaatggagaggttcaggcagaggtgaagaagatgtggagtcggtggaatctctccgtggactggaaaaggacaccgccatgtggcagccgcagatgcggctcagtgctcaccaccgtgacgcacagcaccagcagccagtcacaggtggcggccagcacacgcatggtgcttatctctggcaaagctgccaagatcgccagcagacagcctgacagccacatcactttacctggctatgtctggagtaactcagagcaggactgcctgccacactctttccacgaggagaccaaggaagatagtgggaggcagggagatgatattctaatggagaagccttccaggcctatggaatctaacccagacactgaaggatgccaaggagaaactgaggatgttctctgaatggacatttgtggctgactttcatgggctggtccaatggctggttgtgtgagagggcttggctgatactcctatgcttgagttcaaaggctgaaaattcagttaaggtgttacttaataatagtttttaggctccatgaattggctcctgtaaatactaacgacatgaaaatgcaagtgtcaatggagtagtttattaccttctattggcatcaagttttcctctaaattaatgtatggtatttgctctgtgattgttcatttttttctgctacttttgggtagaaaaaagattcaattgcttggctgtagctttctctcatatatatcaccctaaatataatgaagatcttttagtgtgtatcattttccttttagaaactagtattctcttatttcttactttaatgtacttctatcactgcatttattttgcctgtgcataggagcaattaggatctaaaaaaatatatgggaagataaaagatctaagaacaagtacttgctggaaaattagttggctggacattgataaaataatgcatttataacaattacatgtgtttttgggaacaaggaaaatttctcaaaaaagaatatttcacacatcccttcttttgaatggcctctttgtgaccagccagacctcaggtcttcactctttcttctttgtaaaccatgtcatgtggaaagatttcctcagttagtgagcttgtgtctgcaaattgattttgtttgtaatgtattttgatagcaaatcatgctgcatctatatctttttcttgtttgagctgttactacattgtacatggcatgtgggatcaattaaaaatttgttttaaaaat

SEQ ID NO: 1464 - DNA, 1526 bp; single-stranded, linear
  immediate source library: GENBANK
  immediate source clone: g894158
gtttttttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagat

SEQ ID NO: 1465 - DNA, 3047 bp; single-stranded, linear
  immediate source library: GENBANK
  immediate source clone: g899476
tgggccgcagccctccccgccccgccgaccgcggtcacacactctcggagcctccccgtgagcgggagcgcggcgcacggcgatgcgccgaggcgggcgctgaggcggcgccgcgcgagcagcagcagaggcggcggcggcccccagcccagcccggcgccgccgccgagcccgggccccaaggtgcggcggcgccccaagttcccgccatgagcagccggctcggggggctccgcggccccggggactcccgccccgccgggcgcgaccgcagcgccccgcggccccgacgcgcttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcgcctcagacgatacagcagactctcaagaggacactgcagtattatgaacatcaagttattggttacagggatgcagaaaagaatttccacaatatctctaacagatgctcctatgcagaccactccaacaaagaagaaattgaagatgtctcaggaattcttcagtgtactgctaatatactcggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcagccccagaggagtgaactccttttctcctttcctgtttccatccagctggttccagatcagcatcaaagtgaaacggatttgggtactgaaaagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccaattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagcc

SEQ ID NO: 1466 - DNA, 547 bp; single-stranded, linear
  immediate source library: GENBANK
  immediate source clone: g902001
gcgggacctcagccatgagacttctcatcctggccctccttggcatctgctctctcactgcatacattgtggaaggtgtagggagtgaagtctcagataagaggacctgtgtgagcctcactacccagcgactgccggttagcagaatcaagacctacaccatcacggaaggctccttgagagcagtaatttttattaccaaacgtggcctaaaagtctgtgctgatccacaagccacgtgggtgagagacgtggtcaggagcatggacaggaaatccaacaccagaaataacatgatccagaccaagccaacaggaacccagcaatcgaccaatacagctgtgaccctgactggctagtagtctctggcaccctgtccgtctccagccagccagctcatttcactttacaccctcatggactgagtttatactcaccttttatgaaagcactgcatgaataaaattattcctttgtatttttacttttaaatgtcttctgtattcacttatatgttctaattaataaattatttattattaagaat

SEQ ID NO: 1467 - DNA, 472 bp; single-stranded, linear
  immediate source library: GENBANK
  immediate source clone: g902329
catctgtcaccctctggattatccagtcatcatgaacccatgtttctgtggcttcctagttttgttgtctttttttctcagtcttttagactcccagctgcacaattggattgccttacaaattacctgcttcaaggatgtggaaattcccaatttcttctgtgacccttctcaacaccccacccttgcctgttgtgacaccttcaccaatgacatagtcatgtatttccttgctgccatatttggttttcttcccatttcggggaccttttcatcttactataaaattgtttcctccattctgagggtttcatcatcaagtgggaagtataaagccttctccacctgtggctctcacctgtcagttgtttgcttattttatggaacaggctttggaggggacctcagttcagacatgtcctcttatcccagaaaaggtgcagtggcctcagtgatgtacacggtggttact

SEQ ID NO: 1468 - DNA, 3018 bp; single-stranded, linear
  immediate source library: GENBANK
  immediate source clone: g903745
cagacactggcaagccgcagaagcccagttcgccggccatgaagcagcggttctcgccgctgcagctgctgaagctgctgctgctgctgcaggcgccgctgccacgagcgctgcgcaggctctgccctgagccctgcaactgcgtgcccgacggcgccctgcgtgccccggccccacggccgtccactcgactatcacttgcctacctccctgtcaaagtgatcccatctcaaagtttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaaaacaaacatttgtcaatctcctgagggccacgcttcattaccccagccactgctgtgcatttagaaacttgccaacgaaagagctaaacttctcacattccatttctgaaaacttttccaaacaatgtgaaagcacagtaaggaaaagtgaactgagtggctgggactatgaatatggtttctgcttacccaagacaccccgatgtgctcctgaaccagatgcttttaatccctgtgaagacattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattagcaagtgaactttctgtctacaccctcaccgtcatcactctagaaagatggcacaccatcacctatgctattcacctggaccaaaagctgcgattaagacatgccattctgattatgcttggaggctggctcttttcttctctaattgctatgttgccccttgtcggggtcagcaattacatgaaggtcagtatttgcttccccatggatgtggaaaccactctctcacaagtctatatattaaccatcctgattctcaatgtggtggccttcttaataatttgtgcttgctacattaaaatttattttgcagttcgaaacccagaattaatggctaccaataaagatacaaagattgctaagaaaatggcaatcctcatcttcaccgattttacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgatcctctttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaattacctgtaccagtaattttaacataaagggttggatttaggaaattatttatttttaggtacattaggcaagagacctctaccagtagaaagtgtagtctatgaccactgccacactaaaaactatttgtcattgttacattggcataaatactgaagttgagagtgttttttatagaaattttgacacagtaattttgtttgatgaatcttttaaaaaactgaggaggtattttgcatatcttttttttcattttcgtaatttgtattgcattctataaaaatattagttcataacagatcagaaatttaaaataactggcctttttcctcaggtagtttgaaaaacacactctagagatgcactgtccaatccggtagccactagcacatgtggctaaattaaaattaaataaaatgagaaatgtagtttctcagttgcactagccacgtttcaagttctcaatggctacgtgtgactagtgcttaccatactggacagcacagacacagaatattttcatcaccacagaaagttctatctgttctattatagagacttttatctatgccctatctggattcacttatttataatttaaggtaaacatctgaaagcacatttcagcctatttgcttagtgaaacattaagctgtagactgtaaactcctcgtgagtaggaaccctgtctcagtgcattttgttttcctgcttcctacctcaagatcttggcaatggtacactacaaatgtgctgagttagaattactctgaagttatgaaacatataatgaaaacaattttttctagagcttatatttttatttgaatgaaataaaatgtttaaatatttaaaaataaaaaaaaaa

SEQ ID NO: 1469 - DNA, 2413 bp; single-stranded, linear
  immediate source library: GENBANK
  immediate source clone: g903759
taatacgactcactataggcgaattaagcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagtccttggcattttcaaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgatttctttgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacagctggactcttaagaaacttgcactttccttgagtttccttcacctcacacgggctgacctttcttacccaagccactgctgtgcttttaagaatcagaagaaaatcagaggaatccttgagtccttgatgtgtaatgagagcagtatcgagacgttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatggccctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcacaacccaggggacaaagataccaaaattgccaagaggatggctgtgttgatcttcaccgacttcacgtgcatggccccaatctcattctatgctgtgtcagcaattctgaacaagcctctcatcactgttagcaactccaaaatcttgctggtactcttctatccaattaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgacatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagttt

SEQ ID NO: 1470 - DNA, 1679 bp; single-stranded, linear
  immediate source library: GENBANK
  immediate source clone: g905392
ggcatgttgcaaagatggtttctgccaagaaggtacccgcgatcgctctgtccgccggggtcagtttcgccctcctgcgcttcctgtgcctggcggtttgtttaaacgaatccccaggacagaaccaaaaggaggagaaattgtgcacagaaaatttcacccgcatcctggacagtttgctcgatggttatgacaacaggctgcgtcctggatttgggggtcctgttacagaagtgaaaactgacatatatgtcaccagctttggacctgtttctgatgttgaaatggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgagactcaccataagtgcggagtgtcccatgagattggtggattttcccatggatggtcatgcatgccctttgaaattcgggagttatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggcgaatatattgttatgacggtttacttccacctcagacggaagatgggttattttatgattcagacctatattccgtgcattatgacagtgattctttctcaagtttcattttggataaataaagaatcagttcccgctaggactgtatttggaataacaactgtcctcaccatgaccacactaagcatcagtgcacgacattctttgcccaaagtgtcctacttgaccgccatggactggttcatagctgtctgctttgcttttgtattttcggcccttatcgagtttgctgctgtcaactatttcaccaatattcaaatggaaaaagccaaaagaaagacatcaaagccccctcaggaagttcccgctgctccagtgcagagagagaagcatcctgaagcccctctgcaggatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggacatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaa

SEQ ID NO: 1471 - DNA, 3255 bp; single-stranded, linear
  immediate source library: GENBANK
  immediate source clone: g914099
ggagcgcaaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccttacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttt

SEQ ID NO: 1472 - DNA, 1719 bp; single-stranded, linear
  immediate source library: GENBANK
  immediate source clone: g930336
gatagaccatgagcagccatggcaacagcctgttccttcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcatcgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctg

SEQ ID NO: 1473 - DNA, 1650 bp; single-stranded, linear
  immediate source library: GENBANK
  immediate source clone: g939924
cttgaggagaatgtcgtgcagtagccttaggaatgtgaacattgggagactggctgggattttgtaggttatgagaaggggacacttatgatatgtgaacttgagcccaggagagaagccataaaaagtgaaactgtcctgggcacttggaggtgagtgtctctctagtaagatgcatgtgaaaggcctgggagctgaaagcaaggagagcagaagaggctggtgaagattctaatctgcgtgtccaggggcactcttccaggtctcaggaacgcaggtcagaatgtgcaagccagctgccgggcacgtggctcacccctgtagtaccagcactttgggaggctgagagagaagatcgcttgtggccaggagtttgagaccagactggggcttcatagggagaccctgtctcttaaaaaaaaaaaaaaaaaaggactgagtgagccgagcccagtcctctcatgcactgtgtcattcatcccctttcttaggctgtgttggttctaggctagctgctgtctttctttggtaggctgctaacctctttggattgtgaatttaaaacatgttttacagtaaatttgctgccaagacaagaggtgtatttctccagcaatgaattcctcatttcacctgcatttcttggatctcaacctgaatgccacagagggcaacctttcaggacccaatgtcaaaaacaagtcttcaccatgtgaagacatgggcattgctgtggaggtgtttctcactctgggtgtcatcagcctcttggagaacatcttggtcataggggccatagtgaagaacaaaaacctgcactcccccatgtacttcttcgtgtgcagcctggcagtggcggacatgctggtgagcatgtccagtgcctgggagaccatcaccatctacctactcaacaacaagcacctagtgatagcagacgcctttgtgcgccacattgacaatgtgtttgactccatgatctgcatttccgtggtggcatccatgtgcagcttactggccattgcagtggataggtacgtcaccatcttctacgccctgcgctaccaccacatcatgacggcgaggcgctcaggggccatcatcgccggcatctgggctttctgcacgggctgcggcattgtcttcatcctgtactcagaatccacctacgtcatcctgtgcctcatctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatctcactttaatgctttcttgccctcagaacctctactgctctcgcttcatgtctcacttcaatatgtacctcatactcatcatgtgtaattccgtgatggaccctctcatatatgccttccgcagccaagagatgcggaagacctttaaggagattatttgctgccgtggtttcaggatcgcctgcagctttcccagaagggattaacgacaaagtgctcctctctgtggctctgttctcctttgtttgctcacctatgacaaa

SEQ ID NO: 1474 - DNA, 1216 bp; single-stranded, linear
  immediate source library: GENBANK
  immediate source clone: g940378
gaattctggctattttcctcctgccgttccgactcggcaccagagtctgtctctactgagaacgcagcgcgtcagggccgagctcttcactggcctgctccgcgctcttcaatgccagcgccaggcgctcaccctgcagagcgtcccgcctctcaaagaggggtgtgacccgcgagtttagataggaggttcctgccgtggggaacaccccgccgccctcggagctttttctgtggcgcagcttctccgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgagg

SEQ ID NO: 1475 - DNA, 4074 bp; single-stranded, linear
  immediate source library: GENBANK
  immediate source clone: g945096
gaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaacccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaaacccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgccccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccgggggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacaccgaagaagacgaactggaagaggaggaggaggacctgcaggcggccagcaaactgaccccggatgattcgcctgcgctgacgcctccgtcgcctttccgcgactcggtggcctcgggcagctcggtgcccagctccccagtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttcaggccaggattcggattcttgaattactcgaagccttctctgggaagaaagggaattc

SEQ ID NO: 1476 - DNA, 2456 bp; single-stranded, linear
  immediate source library: GENBANK
  immediate source clone: g951234
gcaagcacggaacaagctgagacggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtaggaaggcataagtaattttagctagtttttaatagtgttctctgtattgtctattatttagaaatgaacaaggcaggaaacaaaagattcccttgaaatttagatcaaattagtaattttgttttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtggaaaaaaaaaaccg

SEQ ID NO: 1477 - DNA, 4079 bp; single-stranded, linear
  immediate source library: GENBANK
  immediate source clone: g951318
gctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccgaagccgtggatctgtcccaccagccaccggccggcaaagaacagcccctggcagtggatggggcctcgggtcccgggaatgggcctcagcatgcctacgatgatgggcaggaggctggctcactcccccatgccaacggctggccccaggcccccaggcaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgtttaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccatcggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacatgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtca

SEQ ID NO: 1478 - DNA, 4062 bp; single-stranded, linear
  immediate source library: GENBANK
  immediate source clone: g951320
taccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaattgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggcatcctggagcgagtggtggatggccccacaccccaccagacagtgcgcctggaggccctggatgagagtggcagctactgggtcagtgacaagaggctgcccccctgctcactcagccaggccctcacctacttcctggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacagagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatctttggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcacaaaaaaaaaaaaaaaa

SEQ ID NO: 1479 - DNA, 1596 bp; single-stranded, linear
  immediate source library: GENBANK
  immediate source clone: g953232
attctgcagatatccatcacactggcggccgctcgagcatgcatctagagcttgccactgcgggattctgtggggtaacctgggtctacggaagtttcctgaaagaggggagaagggtttgcatttttcctatggaggattcttctctctctagcatttcgtttgatgtattcaactggtagaagtgagatttcaacaggtagcagagagcgctcacgtggaggaggtttggggcgccgcggcaccccccacccctcctcgggaccgcgcctatttctaaagttacacgtcgacgaactaacctatgctttaaattcctctttccgaccccgtgagtccgcggcgacattgggccgtggggtggctgggaacggtcccctcctccggaaaaaccagagaacggcttggagagctggaaacgagcgtccgcgagcaggtccgtgcagaaccgggcttcaggaccgctgagctccgtagggcgtccttgggggacgccaggtcgccggctcctctgccctcgttgagatggacaacgcctcgttctcggagccctggcccgccaacgcatcgggcccggacccggcgctgagctgctccaacgcgtcgactctggcgccgctgccggcgccgctggcggtggctgtaccagttgtctacgcggtgatctgcgccgtgggtctggcgggcaactccgccgtgctgtacgtgttgctgcgggcgccccgcatgaagaccgtcaccaacctgttcatcctcaacctggccatcgccgacgagctcttcacgctggtgctgcccatcaacatcgccgacttcctgctgcggcagtggcccttcggggagctcatgtgcaagctcatcgtggctatcgaccagtacaacaccttctccagcctctacttcctcaccgtcatgagcgccgaccgctacctggtggtgttggccactgcggagtcgcgccgggtggccggccgcacctacagcgccgcgcgcgcggtgagcctggccgtgtgggggatcgtcacactcgtcgtgctgcccttcgcagtcttcgcccggctagacgacgagcagggccggcgccagtgcgtgctagtctttccgcagcccgaggccttctggtggcgcgcgagccgcctctacacgctcgtgctgggcttcgccatccccgtgtccaccatctgtgtcctctataccaccctgctgtgccggctgcatgccatgcggctggacagccacgccaaggccctggagcgcgccaagaagcgggtgaccttcctggtggtggcaatcctggcggtgtgcctcctctgctggacgccctaccacctgagcaccgtggtggcgctcaccaccgacctcccgcagacgccgctggtcatcgctatctcctacttcatcaccagcctgacgtacgccaacagctgcctcaaccccttcctctacgccttcctggacgccagcttccgcaggaacctccgccagctgataacttgccgcgcggcagcctgactcccccagcgtccggctccgcaactgcgcgccactcctggccagcgagggaggagccggcgccagagtgcgggaccagacagg

SEQ ID NO: 1480 - DNA, 1518 bp; single-stranded, linear
  immediate source library: GENBANK
  immediate source clone: g953234
tccactagtaacggccgccaggatccacatctcttcccaggagggtggccagcagctgctctctgcgggaggagggaactgatctgctgaagtctcaccaggaagaggcgggaaggcccccacacaccccaccaggctccctctggccccatgtccttgacctggcaaagtggccgcagtctctgccagagaacctggagtggctgtgcctaacagacggctggatctcaaagtctctggttgtttttctttcctagaatccagcctaaggaggcccccaaccagatacccaactccaaggcacctcccacctgcccagggcgcaaatcgtcaacggtcccagctacaatgcaggccgctgggcacccagagccccttgacagcaggggctccttctccctccccacgatgggtgccaacgtctctcaggacaatggcactggccacaatgccaccttctccgagccactgccgttcctctatgtgctcctgcccgccgtgtactccgggatctgtgctgtggggctgactggcaacacggccgtcatccttgtaatcctaagggcgcccaagatgaagacggtgaccaacgtgttcatcctgaacctggccgtcgccgacgggctcttcacgctggtactgcccgtcaacatcgcggagcacctgctgcagtactggcccttcggggagctgctctgcaagctggtgctggccgtcgaccactacaacatcttctccagcatctacttcctagccgtgatgagcgtggaccgatacctggtggtgctggccaccgtgaggtcccgccacatgccctggcgcacctaccggggggcgaaggtcgccagcctgtgtgtctggctgggcgtcacggtcctggttctgcccttcttctctttcgctggcgtctacagcaacgagctgcaggtcccaagctgtgggctgagcttcccgtggcccgagcgggtctggttcaaggccagccgtgtctacactttggtcctgggcttcgtgctgcccgtgtgcaccatctgtgtgctctacacagacctcctgcgcaggctgcgggccgtgcggctccgctctggagccaaggctctaggcaaggccaggcggaaggtgaccgtcctggtcctcgtcgtgctggccgtgtgcctcctctgctggacgcccttccacctggcctctgtcgtggccctgaccacggacctgccccagaccccactggtcatcagtatgtcctacgtcatcaccagcctcacgtacgccaactcgtgcctgaaccccttcctctacgcctttctagatgacaacttccggaagaacttccgcagcatattgcggtgctgaagggcctgggcaccatcatccccatcatcatcatcacccccatcatcatcacccccaccattacccccatcgtcacgcccatcatcacgcccatcatcaccccccatcatcacccccatcatcatgcccatcatcaccccccatcatcatcatgcccacccctcatca

SEQ ID NO: 1481 - DNA, 1105 bp; single-stranded, linear
  immediate source library: GENBANK
  immediate source clone: g971193
ggagagtctgcgatgtcagagaacggctccttcgccaactgctgcgaggcgggcgggtgggcagtgcgcccgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcaggtaatttgttcttggtgagtctggcattggctgacctggtggtggccttctacccctacccgctaatcctcgtggccatcttctatgacggctgggccctgggggaggagcactgcaaggccagcgcctttgtgatgggcctgagcgtcatcggctctgtcttcaatatcactgccatcgccattaaccgctactgctacatctgccacagcatggcctaccaccgaatctaccggcgctggcacacccctctgcacatctgcctcatctggctcctcaccgtggtggccttgctgcccaacttctttgtggggtccctggagtacgacccacgcatctattcctgcaccttcatccagaccgccagcacccagtacacggcggcagtggtggtcatccacttcctcctccctatcgctgtcgtgtccttctgctacctgcgcatctgggtgctggtgcttcaggcccgcaggaaagccaagccagagagcaggctgtgcctgaagcccagcgacttgcggagctttctaaccatgtttgtggtgtttgtgatctttgccatctgctgggctccacttaactgcatcggcctcgctgtggccatcaacccccaagaaatggctccccagatccctgaggggctatttgtcactagctacttactggcttatttcaacagctgcctgaatgccattgtctatgggctcttgaaccaaaacttccgcagggaatacaagaggatcctcttggccctttggaacccacggcactgcattcaagatgcttccaagggcagccacgcggaggggctgcagagcccagctccacccatcattggtgtgcagcaccaggcagatgctctctagcctg

SEQ ID NO: 1482 - DNA, 2025 bp; single-stranded, linear
  immediate source library: GENBANK
  immediate source clone: g984506
cggcacgaggcaccccgagaggagaagcgcagcgcagtggcgagaggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcttgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctccctagggccaagcgcaagtccgtgcgcaccatcgccgtggtgctggctgtcttcgccctctgcttcctgccattccacgtcacccgcaccctctactactccttccgctcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggataggagatgtgttgggcagcagtgaggacttcaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagcagtgtgaggctgtaacttatactaaaggttgtgttgcctgctaaaaaaaa

SEQ ID NO: 1483 - DNA, 3416 bp; single-stranded, linear
  immediate source library: GENBANK
  immediate source clone: g988304
cggtacaggtaagtcggccgggcaggtaggggtgcccgaggagtagtcgctggagtccgcgcctccctgggactgcaatgtgccggtcttagctgctgcctgagaggatgtctggggtgtccgagcccctgagccgagtaaagttgggcacattacgccggcctgaaggccctgcagagcccatggtggtggtaccagtagatgtggaaaaggaggacgtgcgtatcctcaaggtctgcttctatagcaacagcttcaatcctgggaagaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggaccgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcgcagcagaacgccgtgacctccctgagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggagaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcct

SEQ ID NO: 1484 - DNA, 1900 bp; single-stranded, linear
  immediate source library: GENBANK
  immediate source clone: g992699
gatccagaaagcccccaagagagatgctgaaactctcaggtgggtaaaaagagtagacctctgacgtcccagggtacagcccttgctgccatcctgggggcaccctcctaagtgccaggggcaagccatggtcaggggaagcagaaagcggtgacaccccggccactgcacctgtgggcaggtgggtcagggagggtccaggcactcaggatgaacagaactcacctgccaaggcttgggctgaggaggagctggaatcctggagacacactgcccccgcccctcaccacccctgtcactcagacagcacacctcagaggcagaacagaaaacccagagcctcacccaggcaaggctcacgtcccattccccgccatggcactgacccggtcctcccagctctgaggagcctcagatctcctgggtggcaggggtgcagctgcatagcgccgaaattccaagccctggttctgcgtttgccttgtgctgaagttcagaatgcctctgacgctcacgcacaccaaatggacaaggaggtcccctcagcagccccgtgggcggtgctgagcttgaaagtgggaggttctgaaggcattggaggcctgacttctggacttcagagagcgtgaagctgcctagatcgcaagctcattgtgaactgtttgcttgttccctccaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccagcgcgagcgcagactgtttaggactcagcagacccagcaagaggcatctgccctttccccagccacctccccggcaagcaacctgaaatctcagcagatgcccaccatttctctagatcgcctagtctcaacccataaaaaggaagaactgacaaaggggatcc

SEQ ID NO: 1485 - DNA, 407 bp; single-stranded, linear
  immediate source library: GENBANK
  immediate source clone: g994730
cttaaaatccctaagnttaccaacccctcagcccaaatccagcccctaatcccccataggctgcccgggcagatggggtggatgacctgcccaggtcagcagatcagctggccggggcctgcctgacatttggcccacagaacccaccatggccccctttgagcccctggcttctggcatcctgttgttgctgtggctgatagcccccagcagggcctgcacctgtgtcccaccccacccacagacggccttctgcaattccgacctcggtgagtccttgatccccactcagcccacacactctgccttggtttccctttcagtccagtggggctcaccatggccacttacgctctagaatgattccactcgcccctgcacttgctctgctttagccacactggcat

SEQ ID NO: 1486 - DNA, 453 bp; single-stranded, linear
  immediate source library: GENBANK
  immediate source clone: g995656
ccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactagaggaaaaaaatattaaagaatttttgcagagttttgtacatattgtccaaatgttcatcaacacttctt

SEQ ID NO: 1487 - DNA, 1194 bp; single-stranded, linear
  immediate source library: GENBANK
  immediate source clone: g995918
ggcacgagcccagcgccgccgccatgtcctccggggctagcgcgagcgccctgcagcgcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactctaggagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttgtgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttctcatgaatttataattcctaaatgaagaccagaaagtacaaattgctgggaggaagaataggctttattaatcaactgatgtcttgatttttctaaatgggaagattgctttatttttaacactaattatgggagcagattcttaccaaacttctttggaaaagttaatgttatgatgtgcattaggctgccccatcgtgtatataaatgaaggcagatttgatttttgtattcttacgtttactctgctttgtagttgtggctgtacttaaagcaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaatt

SEQ ID NO: 1488 - DNA, 1767 bp; single-stranded, linear
  immediate source library: GENBANK
  immediate source clone: g995934
gaattccggctccctcccgccggccggggtgcgcgggccggcggggccggcccgggccgggccaatgcgttcggcgcggcccagcccggccggccggggggggcgccccgagcccgggccccgcgcggcccgcgcccccggcccccgctgagccctgggggccccgcagcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggccggatcacctcaacagtcacgtcagacaagtgcactcaacagaacggcccttcaaatgtgagaaatgtgaggcagctttcgccacgaaggatcggctgcgggcgcacacagtacgacacgaggagaaagtgccatgtcacgtgtgtggcaagatgatgagctcggcttatatttcggaccacatgaaggtgcacagccagggtcctcaccatgtctgtgagctctgcaacaaaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattc

SEQ ID NO: 1489 - DNA, 3440 bp; single-stranded, linear
  immediate source library: GENBANK
  immediate source clone: g998769
ttcggccttcccagcgccccttgcgcctctcgggaggccccagcgcggacccagcctggctgggccgtcccctccggatgggccggcgggcggagcagcgcagaggcaccgccctcggcccgcccgccggggaggggacgcgagcgggaggctcgccagcggcgcccgccgggggcccgccgcactctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagcacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctagccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgagggggaaggggtggaactaagatgggtttataactggaacctccaatgaccagactgtatatagagatttacaaagatttttatattaatttaataaaacaaattcttaaatagaacaaaataaacacctaatgagccactttatatataaaaaaaaaaaaaaaaa

SEQ ID NO: 1490 - DNA, 2621 bp; single-stranded, linear
  immediate source library: GENBANK
  immediate source clone: g999415
ccatgggatcgctgcttgcgctcctggcactgctgccgctgtggggtgctgtggctgagggcccagccaagaaggtgctgaccctggagggagacttggtgctgggtgggctgttcccagtgcaccagaagggcggcccagcagaggactgtggtcctgtcaatgagcaccgtggcatccagcgcctggaggccatgctttttgcactggaccgcatcaaccgtgacccgcacctgctgcctggcgtgcgcctgggtgcacacatcctcgacagttgctccaaggacacacatgcgctggagcaggcactggactttgtgcgtgcctcactcagccgtggtgctgatggatcacgccacatctgccccgacggctcttatgcgacccatggtgatgctcccactgccatcactggtgttattggcggttcctacagtgatgtctccatccaggtggccaacctcttgaggctatttcagatcccacagattagctacgcctctaccagtgccaagctgagtgacaagtcccgctatgactactttgcccgcacagtgcctcctgacttcttccaagccaaggccatggctgagattctccgcttcttcaactggacctatgtgtccactgaggcctctgagggcgactatggcgagacaggcattgaggcctttgagctagaggctcgtgcccgcaacatctgtgtggccacctcggagaaagtgggccgtgccatgagccgcgcggcctttgagggtgtggtgcgagccctgctgcagaagcccagtgcccgcgtggctgtcctgttcacccgttctgaggatgcccgggagctgcttgctgccagccagcgcctcaatgccagcttcacctgggtggccagtgatggttggggggccctggagagtgtggtggcaggcagtgagggggctgctgagggtgctatcaccatcgagctggcctcctaccccatcagtgactttgcctcctacttccagagcctggacccttggaacaacagccggaacccctggttccgtgaattctgggagcagaggttccgctgcagcttccggcagcgagactgcgcagcccactctctccgggctgtgccctttgaacaggagtccaagatcatgtttgtggtcaatgcagtgtacgccatggcccatgcgctccacaacatgcaccgtgccctctgccccaacaccacccggctctgtgacgcgatgcggccagttaacgggcgccgcctctacaaggactttgtgctcaacgtcaagtttgatgccccctttcgcccagctgacacccacaatgaggtccgctttgaccgctttggtgatggtattggccgctacaacatcttcacctatctgcgtgcaggcagtgggcgctatcgctaccagaaggtgggctactgggcagaaggcttgactctggacaccagcctcatcccatgggcctcaccgtcagccggccccctggccgcctctcgctgcagtgagccctgcctccagaatgaggtgaagagtgtgcagccgggcgaagtctgctgctggctctgcattccgtgccagccctatgagtaccgattggacgaattcacttgcgctgattgtggcctgggctactggcccaatgccagcctgactggctgcttcgaactgccccaggagtacatccgctggggcgatgcctgggctgtgggacctgtcaccatcgcctgcctcggtgccctggccaccctgtttgtgctgggtgtctttgtgcggcacaatgccacaccagtggtcaaggcctcaggtcgggagctctgctacatcctgctgggtggtgtcttcctctgctactgcatgaccttcatcttcattgccaagccatccacggcagtgtgtaccttacggcgtcttggtttgggcactgccttctctgtctgctactcagccctgctcaccaagaccaaccgcattgcacgcatcttcggtggggcccgggagggtgcccagcggccacgcttcatcagtcctgcctcacaggtggccatctgcctggcacttatctcgggccagctgctcatcgtggtcgcctggctggtggtggaggcaccgggcacaggcaaggagacagcccccgaacggcgggaggtggtgacactgcgctgcaaccaccgcgatgcaagtatgttgggctcgctggcctacaatgtgctcctcatcgcgctctgcacgctttatgccttcaatactcgcaagtgccccgaaaacttcaacgaggccaagttcattggcttcaccatgtacaccacctgcatcatctggctggcattgttgcccatcttctatgtcacctccagtgactaccgggtacagaccaccaccatgtgcgtgtcagtcagcctcagcggctccgtggtgcttggctgcctctttgcgcccaagctgcacatcatcctcttccagccgcagaagaacgtggttagccaccgggcacccaccagccgctttggcagtgctgctgccagggccagctccagccttggccaagggtctggctcccagtttgtccccactgtttgcaatggccgtgaggtggtggactcgacaacgtcatcgctttga

What is claimed is:

1. A combination comprising a plurality of polynucleotide probes, wherein said plurality of probes are SEQ ID NOs:1–1490.

2. The combination of claim 1, wherein said plurality of probes are complementary DNAs.

3. The combination of claim 1, wherein said plurality of probes are clone DNAs.

4. The combination of claim 1, wherein said plurality of probes are immobilized on a substrate.

5. The combination of claim 4, wherein said plurality of probes are hybridizable array elements in a microarray.

* * * * *